United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 25

SEQ ID NO: 27960 - DNA, 7876 bp, Homo sapiens
caccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctcttgcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgagaaagaaagaaagaagagagaaaggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatgatctttaaaaggttctgctttagcaagataaaaagtataaatgatgctactttattttggcaacatggaaattttgtttttcttttccaataaaatccatattttcgtgaaatttttaaaaataaatttgtatcaaggattagtctgaattttatcataatagaaatttataattactaagaattaaatttttaatcatttttaaagctgtgttcttctctacacccacagccaaaatggaaattcactgtatggtatttgggaatatatttcacctgtaaaagaaagaatgtccacaattcaaacggttttgagttaatagataggaatccctcagtcaaactacagaattttttttgttttatatattcttagtcagcagagtgtttgagctataattacaagtatttccacttctaaatcttcttttagaaaagcagataactataataccttggctctgccactgactcctgccgtatgatattggacaaatcactgcccttttcagtttctcatctttagaatggggagttgggattgccagtggttttcaagcttttcttaacagcagggctttttttctaataaaattgcacatggaatcctggtaggcaaaacagctcaaagcaatgcaggagtttctccaacagtttaaattggggctccccagagcatggtttaaataccataacagtacacaatgatctatcatgtgtcttccaactctgaagttccacagttgtaatttactcagataaaccaccttttgaggctttataagcaaacttgtaaaaacacagtaattgaatgatatacaataaaaactgacagagtgtttaccatgtaccagtcactagagatattagctcatttaattctcttatcaatcaaaaaattgtaagtactctttttaattcctgttttacaagtgatgacactgaggcttaaatagaataatctccccaaaatgacacggcagctgaaagtaacccagctattctgactgcaaaggaaacgccttaattgctttgtccaccctgaacaaaacaatctgttttatgtcactatacgtactccatttgaatgccaaggtagaaggcaccatgaaaaaccattaccaaaataaggataattccaataacaaaactgtcaaaaaagaatcactgcttctcaaaatatgattggtatcatcacttattaatgttttgtatcatcacttattaatgattttggcttggtcaccactatgcctggaagatagtaggcactgataaacattgttaaacaccgtaacaacacaaaatgatctaccacatatcaatgtcttccatctctgaaattccatgattctactttactcagatataccaccttttgtggcattataaggaaacatgtataatcaagttcatacaagctatacacagtaggcatcgataaatttgtattgacagcataaacttctagggatgagatttgggaatatacattttgataagtgctccaaatttgagaatcattgctctagtagatctctaaggtccttcttagttctgacattatatcagattttaagcattaaattctaagatgaaaaccatttttctagtcagtttatttttcattcagtccacttaatttcctccaatcttaaaaaatttttttccctaggaaaatccctatctttttcttaaagttactctgttatactatctcagtctcaaagtagcctgaaatgcattttctcattttcatatttctgtccttttcttcaatgtcttaaaagacttgaagtagaagggaagttgcaagctgttatttattcaaatacaaaatcctaatcaatgtttccttctttgcaagggacattcagatctctaacttgtgagttgaacctatttattttgtaagcttttgactttacaaacatgtggtagcctcattctaaaagagttgcacgaatattttttctcaaaataaccacaggctgtaaattaaattgaacaatacagtagaatatgcagatacatactaaacagatgagtgtgtgtgtatgtgtctgtgtttaagcttttccttttccaaaagattatacatttgagcaaaatcccattcagtctaaatgtactcattttgccacatggttttctgatcagcaatttttttaaaaaatggaagtgttacattatatttaataatatcaaaacaagagtgatctctaaatatagctttgaaagttaatataatatgatgtgtccatgcaatgagtcaaattagattgttgatataaatgaacaaatcaatccaagttacattgattaaagggactatttggatgaccagcctcaccatcttttactgtgtgcactttcctcttaaggttttattgtattttccctgctcctttaggcttttttttcatgtggaaaacagtatctaaatgccattctctcacttatgaattaaatatggctaccattaatgttcctttttgtcagtggagtgtatggaaggaaaatgagataggagtacattgcttaagtctctaaatattaaaaacaacaacaaaac

SEQ ID NO: 27961 - DNA, 951 bp, Homo sapiens
gagagacgcacagatgtgcacggaggccacagacactgacatttggaattccttcaggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaaca

SEQ ID NO: 27962 - DNA, 3646 bp, Homo sapiens
aaaaacagcaggttgcatgacagtttctcagtgaagaggttcaaaaaaggtgagatgctattgctttgtgaatttacaaaggaaagaataatttaactgctcagaattacatgtccggtcactgctttttaatttaaaaaataatagagcatcattagtaatcttgttttctctttgatacataggtaaagggtgttttgtgtctggatgcctaaggtgattccaagggaggggatggaagatatgtgacatcttccctgaaatttatattgatatgcaatgctttgtcatttaaaacctaagctaatgttttctacaatccataactctgagtttatctttttggaaacatagaaggggatgacattgaagatgaaatggatacagcaattgctgaatgacagtttgcccaaattagtgcagttaaaatatgctgacgcccctgcatggccaggaagacttctgctccatgcacacaagcaccaagtatcaagcgaccaccaacacattcccattcctttaggcctccatagctttgcttttgctttctgtttcctgaactaaaaaaaaaaaaaaaagtgtagattgccagccttccctttttcctgcacgctaatggcatgtagtgcctccacccttccctatagtgagattaatgacctgctctgtaactcacattgtgtccttctctctccctttccttaacccttcccatcccgcttcaactcctggccatacagagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatatt

SEQ ID NO: 27963 - DNA, 2465 bp, Homo sapiens
gggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttct

SEQ ID NO: 27964 - DNA, 1404 bp, Homo sapiens
gcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccaggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcg

SEQ ID NO: 27965 - DNA, 2194 bp, Homo sapiens
agcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctac

SEQ ID NO: 27966 - DNA, 2565 bp, Homo sapiens
atagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatgcagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaccaaa

SEQ ID NO: 27967 - DNA, 2658 bp, Homo sapiens
gttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccaggatccctcgaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatgcagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagac

SEQ ID NO: 27968 - DNA, 1282 bp, Homo sapiens
acagagttgattgaggcagtaggaaatgggaagataaagctggcagctctttccacacatggaaagcataataggaaagaagggcttaagttagcagaaagtgagtgagaaggttggaggagctgaaggaaccaagctagatgatgacttcaaagagatggaaaggtccttttgttgctccacaaacaacgccacgctgttcacgagtccttacacctaagttcaggaaataccaacttttcttcagggaagaaagaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacac

SEQ ID NO: 27969 - DNA, 1025 bp, Homo sapiens
gttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcct

SEQ ID NO: 27970 - DNA, 2012 bp, Homo sapiens
gcgatgtcggtggccgggctgaagaagcagttccacaaagccagccagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggttatgaggctggttcttgggtttgactctgggaatcatgctcattgatctgcttttcctaatcatgtcagtgaatacctacacgtgaagaaaactcaagctgcaccataaagctaaaggaagaaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 27971 - DNA, 1806 bp, Homo sapiens
gcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaa

SEQ ID NO: 27972 - DNA, 1520 bp, Homo sapiens
atggatggaatctttgctgggataatatgcaatcaagctaataggtgccttacctggacctcccaacagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 27973 - DNA, 1752 bp, Homo sapiens
tgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcg

SEQ ID NO: 27974 - DNA, 1944 bp, Homo sapiens
gccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaaggcctgaaggtctccctccagcttctctgctgccctttccagctcacggagcaaaaggaaagactacctttgaagggacaattctgtaccgagctgcaccgggaaagacggagggccacagacgctattacagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtg

SEQ ID NO: 27975 - DNA, 2678 bp, Homo sapiens
gagcacggaacttattcctgcccagagttcagacacagccagaaattaccatttcatacttcacagaatggaggtttcagcagccaaagccccaagtgccgcagacttgtctgagattgaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaa

SEQ ID NO: 27976 - DNA, 4873 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaaggcctgaaggtctccctccagcttctctgctgccctttccagctcacggagcaaaaggaaagactacctttgaagggacaattctgtaccgagctgcaccgggaaagacggagggccacagacgctattacagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttca

SEQ ID NO: 27977 - DNA, 3819 bp, Homo sapiens
tttggtcccaagtatgactcagggttaggctgggtcctcaggctccgtgctgttggaaggaagtgggaggattccaggggagttctgggaccttttcaaactgaagagaggaggctggctgcatcatgggagaagagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaa

SEQ ID NO: 27978 - DNA, 1941 bp, Homo sapiens
ctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaaggcctgaaggtctccctccagcttctctgctgccctttccagctcacggagcaaaaggaaagactacctttgaagggacaattctgtaccgagctgcaccgggaaagacggagggccacagacgctattacagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaata

SEQ ID NO: 27979 - DNA, 2737 bp, Homo sapiens
tttgagacaagcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagg

SEQ ID NO: 27980 - DNA, 4731 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaata

SEQ ID NO: 27981 - DNA, 518 bp, Homo sapiens
cgccaaggcggtggcgtggatcttgataggccgtgagctctttggcagaaatgaaactgttaacaaaggatggaaagaagcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaa

SEQ ID NO: 27982 - DNA, 663 bp, Homo sapiens
gctgctgtgaacagaggcagcaactggggaattggatatggaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaat

SEQ ID NO: 27983 - DNA, 1549 bp, Homo sapiens
actcttgagggtcaccgacatttggagttttctttgtgagtggagcagctactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagc

SEQ ID NO: 27984 - DNA, 3128 bp, Homo sapiens
ggctgagggtccgcgccgccgcccgcccgctccttcccgctcggccgcggcctcagggacggatactccagcgcgcggttccaaccgaggcccgtggtttagccccacgaagatgaactgggcacccgcaacgtgctgggctctgctactggcggccgccttcctctgcgacagcggcgcagccaagggcggccgcggaggtgcgcggggcagtgcccggggaggggtccgcgggggtgcgcgcggggcctcgagggtgcgcgtgaggccggcgcagcgctacggtgccccgggctcctccctgcgcgtggctgccgccggggcggcagccggggcggcggcgggagcggccgcgggcctggcggcgggctcgggctggagaagggccgcgggacccggggaacgcggcctggaggacgaggaggacggggtgcccggaggcaacgggacaggccccggcatctacagctaccgggcgtggacttcgggcgctggacccacgcgcggcccgcgtctctgtctcgtgctgggcggcgccctcggagccctggggctgctgcggccctaggcctggctgggctcggggaccacatctggcccccggcccgcgccatcccccaggatcctccggcctgggctcccccttcctcccttgcccacggtcttggagccccactgggtgcaggagctgctggctgtccctgtggacccgccatccaccgtcctgcccacgccgcctcagcctgccacctcccacctagaggagaccatgggccctgccccacccactccaggatgttagggtcccctcagccaaaaaggcagctgcctgtggctcctgtaccaaccgcccagccacgctccatcgccgcccaaagggaggtgccaaggccaggaacccaagccaccccggctcccctcgcctgcccaggggccgtggtgactcacgggcagggaggcgacatcaggctggttctgccactgagcccctgaggaatctgaccctccccaaaagaagcagtgaaatggaccaaaggacttaagaatttggggggaagtgagggaaaaacgttaggtgctaaccacctgcccagaagagtggatctcacagcccaggaacattcccaagcaggaaaaccgtccgtccgaggaacgtccatcctggctctctgcggctggtgggaaaacacaccctgccctgaggggctgtccaggccttctcccccacaccctcaggccgagatccgtgagagacccactttgctccaacaacttgaaacaagtcactttaccctccttaggacccattttgggggggaaaaaccaacacattccagagctttccaagtcctttgaacttcaggttcacattcagggatcacacagttctgcctgttctcagggcacagcaactgccaatcccgctgaagaggcctccctgggcacagcacaggctgcacggtgcacgcatttccctgaaggcagccccttcttcggaagcagctgttccaggcctcggaacagggcctgggtatccgcgtggtgggctggcagctgacggcctgctcagtggagccaggagctaactcagaccccaaagcaagcagggggccagtggcggggcccagcgcccagcaggacacccatgcaagaggctgagccccccaacatccaaggacaggagagacatggagtggcgctggacagtcacgacaaggacttgcctccagcactggacacacctgtgttaagaccagccctctgcttcccagtcccgccagcctggggcatcctccatgggctcagcactgagaggtcttgggtctgccacgttctctagctctccagtcacccactcatccagggtaggaggggttctccctgccccccgccgtggccttgggatctcaccctctccatgtcctggggacagcctcgccctcagccggactgcatccctcctgggcctgagcctcgggactcagtggacaccaaagtcaagaccagcacccaccacgggccctgccagcctctgccttccccagctggcctgggttctggcctgggtgaggatctggaagctgttggcaggactcaaccaagcactgctctctagctccagggcactaagccacaggaggcagcgccctgcagcctcccgtccacactgccagcaatgcccctggcccagtgagcccagacgctcctccaccccttccagaccaagctcaacgcctccaagaccagcaggccaaggccaagccctgccccagatcctcataggcagagaagcccttctgacatttcccccaggaggcagggggtggtctgagtctcctcacagcagagagacccaccggagccccctcaactttgcagatgcccacctggaaaatgggctgagctgcaccagaccctcacacaccacagcactgcaagctgatggaatgttccagttatgatggacacttcgtgatctgcaatgactgttgattcagcacattagcatctgacacagccaacctgaatacttcctgccccaggcggtcagggttatggcacgatgcaggtggcactcaggggctaacttcaggctgatgagtgtgtggggtatggggcagcagaggcagccagccagcaaagaggggccactgagcaccagggccctggtggaggctgctgtgggacggtcaggccaccaccgcaaagaggcagccggagcttctgcacaggatgtccctggccccaggtcctgcagcaccttagtccatactaccagccccacccaccttccttcctcttccctcttctaggacacaggctgtggaccccttcaggtgcactataatggggctggaggggcccccacatctctcagccccactaatgcagaatcccactacccgtgagctagaaggtgctcagaggccaggggtctctactgcccatgccgggcggccttccagtcattgcacagcaaagccatgtgcagggcgtccccctcaaccctgccctgaacatgccccagggcactgaggggcgaagccagtgcttgggctctgctgctgggagtctctggtctgtgtctgtgtgtgcctgtaagtgtgaaataaacctctctgatggca

SEQ ID NO: 27985 - DNA, 3172 bp, Homo sapiens
ggcggaggcctcgcgcaaaacccaggcgccgcggctccgcgctccggctgagggtccgcgccgccgcccgcccgctccttcccgctcggccgcggcctcagggacggatactccagcgcgcggttccaaccgaggcccgtggtttagccccacgaagatgaactgggcacccgcaacgtgctgggctctgctactggcggccgccttcctctgcgacagcggcgcagccaagggcggccgcggaggtgcgcggggcagtgcccggggaggggtccgcgggggtgcgcgcggggcctcgagggtgcgcgtgaggccggcgcagcgctacggtgccccgggctcctccctgcgcgtggctgccgccggggcggcagccggggcggcggcgggagcggccgcgggcctggcggcgggctcgggctggagaagggccgcgggacccggggaacgcggcctggaggacgaggaggacggggtgcccggaggcaacgggacaggccccggcatctacagctaccgggcgtggacttcgggcgctggacccacgcgcggcccgcgtctctgtctcgtgctgggcggcgccctcggagccctggggctgctgcggccctaggcctggctgggctcggggaccacatctggcccccggcccgcgccatcccccaggatcctccggcctgggctcccccttcctcccttgcccacggtcttggagccccactgggtgcaggagctgctggctgtccctgtggacccgccatccaccgtcctgcccacgccgcctcagcctgccacctcccacctagaggagaccatgggccctgccccacccactccaggatgttagggtcccctcagccaaaaaggcagctgcctgtggctcctgtaccaaccgcccagccacgctccatcgccgcccaaagggaggtgccaaggccaggaacccaagccaccccggctcccctcgcctgcccaggggccgtggtgactcacgggcagggaggcgacatcaggctggttctgccactgagcccctgaggaatctgaccctccccaaaagaagcagtgaaatggaccaaaggacttaagaatttggggggaagtgagggaaaaacgttaggtgctaaccacctgcccagaagagtggatctcacagcccaggaacattcccaagcaggaaaaccgtccgtccgaggaacgtccatcctggctctctgcggctggtgggaaaacacaccctgccctgaggggctgtccaggccttctcccccacaccctcaggccgagatccgtgagagacccactttgctccaacaacttgaaacaagtcactttaccctccttaggacccattttgggggggaaaaaccaacacattccagagctttccaagtcctttgaacttcaggttcacattcagggatcacacagttctgcctgttctcagggcacagcaactgccaatcccgctgaagaggcctccctgggcacagcacaggctgcacggtgcacgcatttccctgaaggcagccccttcttcggaagcagctgttccaggcctcggaacagggcctgggtatccgcgtggtgggctggcagctgacggcctgctcagtggagccaggagctaactcagaccccaaagcaagcagggggccagtggcggggcccagcgcccagcaggacacccatgcaagaggctgagccccccaacatccaaggacaggagagacatggagtggcgctggacagtcacgacaaggacttgcctccagcactggacacacctgtgttaagaccagccctctgcttcccagtcccgccagcctggggcatcctccatgggctcagcactgagaggtcttgggtctgccacgttctctagctctccagtcacccactcatccagggtaggaggggttctccctgccccccgccgtggccttgggatctcaccctctccatgtcctggggacagcctcgccctcagccggactgcatccctcctgggcctgagcctcgggactcagtggacaccaaagtcaagaccagcacccaccacgggccctgccagcctctgccttccccagctggcctgggttctggcctgggtgaggatctggaagctgttggcaggactcaaccaagcactgctctctagctccagggcactaagccacaggaggcagcgccctgcagcctcccgtccacactgccagcaatgcccctggcccagtgagcccagacgctcctccaccccttccagaccaagctcaacgcctccaagaccagcaggccaaggccaagccctgccccagatcctcataggcagagaagcccttctgacatttcccccaggaggcagggggtggtctgagtctcctcacagcagagagacccaccggagccccctcaactttgcagatgcccacctggaaaatgggctgagctgcaccagaccctcacacaccacagcactgcaagctgatggaatgttccagttatgatggacacttcgtgatctgcaatgactgttgattcagcacattagcatctgacacagccaacctgaatacttcctgccccaggcggtcagggttatggcacgatgcaggtggcactcaggggctaacttcaggctgatgagtgtgtggggtatggggcagcagaggcagccagccagcaaagaggggccactgagcaccagggccctggtggaggctgctgtgggacggtcaggccaccaccgcaaagaggcagccggagcttctgcacaggatgtccctggccccaggtcctgcagcaccttagtccatactaccagccccacccaccttccttcctcttccctcttctaggacacaggctgtggaccccttcaggtgcactataatggggctggaggggcccccacatctctcagccccactaatgcagaatcccactacccgtgagctagaaggtgctcagaggccaggggtctctactgcccatgccgggcggccttccagtcattgcacagcaaagccatgtgcagggcgtccccctcaaccctgccctgaacatgccccagggcactgaggggcgaagccagtgcttgggctctgctgctgggagtctctggtctgtgtctgtgtgtgcctgtaagtgtgaaataaacctctctgatggc

SEQ ID NO: 27986 - DNA, 1687 bp, Homo sapiens
gtgtgggcgtggcgggggctggggtctgcgggcgaaggtggcagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagcggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagcca

SEQ ID NO: 27987 - DNA, 1765 bp, Homo sapiens
attggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagcggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagcca

SEQ ID NO: 27988 - DNA, 3461 bp, Homo sapiens
tatctcatttccaggcattgctggttcgtttttttcgaaaatcattccaaattatattccaattcgactttcttcaagttcatcccagaaaagcaaaggccgggcacttgaacaagaacagctgtcagcctggggcgagggggcagtgttggtgggggctggagcggggccggactctaattggtccacggcctcggcccgactatcaaatcagcagagcctgcgtcatcacgtcgttgcctgggctgccgtccgcggaaatttgaaatggctgacgggtcgctgacgggcggcggtctggaggcagcggccatggcgccggagcgcatgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtagtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaa

SEQ ID NO: 27989 - DNA, 2369 bp, Homo sapiens
atgcatccggtgagcagaaggaaactccgtgcgtcgcccggcgcctgtccgagtctgggaaccggtaccaagttttcgcgcagaccccgggcgcgaagctggccccgaggctgggaagtcgtccgcttccttccttcctcctccttccaccttcctccctcctccctcctccctcctcctccctcctcctcctcctgctcccccggacagaggttccgggaaccagccgggccggggcggggcggggcgagggagaggggcggccgcgcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgctgccccctttcttcctggcctcggctgctggaattggaatcaggctgtactctttccatccatttgggcttct

SEQ ID NO: 27990 - DNA, 575 bp, Homo sapiens
actgcgcccggcgctcgcgtccgtccgcccgtccgcccgcccagccatgactgcgccggtccccgcgccgcggatcctgttgccgttgctgttgctgctgctgctaacgccgcctccgggtgccctagctcagaggctcagattgggctgtgaagaccttgctgcatatgggttcacctgagccaccaggcacgggccatgctgatgataccagctttcagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtc

SEQ ID NO: 27991 - DNA, 1839 bp, Homo sapiens
gggcggggccatcctgtgtctttaagagggtggaacggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 27992 - DNA, 2250 bp, Homo sapiens
agtcctggcccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaaggtctgcgctgggcactgtcctcgcaccgcctcacctagtcctcacgtagccctcgggcaagtgaggatccgccgggactgcggctgggagggatggctgtggctgtcccccagcccacacagtaggcgctcagtgtcagggtgcatattcccggggacgccctccaggcctgagagctgggggccgccgccgccccccatgcatccgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 27993 - DNA, 2081 bp, Homo sapiens
gtgtgccctgggagctgccagtttctagctcagtcctggcccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgct

SEQ ID NO: 27994 - DNA, 1732 bp, Homo sapiens
tgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccaggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaggcggccctctgagcattccctggcctctctggctgccacttggttatgttgtgtgtgtgcgtgagtggtgtgcaggcgcggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 27995 - DNA, 4043 bp, Homo sapiens
gtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggctctatgacaatctgctgtttatggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcatttgtggttatcctaaggctttgaccagcttcccaggctggagaagtccatgtgtgcatgcatctactgttggccacagaaaagtcttaatttatttttctttgcagggtatgttgacttctctttgggcactgagtccttgcattttaaaaatcaacttcattgaagtataatttacacaataaaatgcacacattgtaagtgtgtagtttgatgagcttggacaaatgtctatacctgtgtaatcattactctagaaagctcactcatgcccattgcccttgcatttttgaaaaataattgatgcttcttgtgcaagaagaagtgctcaggaactctattcaagtgtttaaaagtcaacacatagattggacattgggatacctggaggctttgaagcaagataccgggactctgagttctgtttggaaatattggtgtcatatatttgtcattgtaattggaaagaaaagagatgcaccattttcttcttgttctttggataagctaagctcattcccatcttggagctgttgcactggcccttgtgtggctggtccctcctcatcaccagggtcccagctccaatgtcatcttctctgagaagccgtccctgaccaggcttagttgcttcccaccccagcctgacacactccagcccatcacccagtcagtgttatttgcttcatttttacattatggtctaaaattaacttgctagtttactggtttactagtttattatctgtctccttccattatccctctccttccctccttcccttccccttccttccttccttccttccttccttcgagacacagtcgtactctgtcaccccggctggagtgcagtggtgtgatcttgcctcactacaacccctgcctcctgggttttagcgattcttctgcctcagcctcccgagtagctgggactacaggcacccaccatgatgccaggctaatttttgtatttttattggagacagggtttcaccatgttggccaggctggtctcgaactcttgacctcaagtgatccacctgtctcggcctcccaaagtgctgggattacaggcatgagccactgcacctggcccttttattattcatagtaagacacacagggaccacaattgtctcttctactcagtagttggattctgagtgcctagttcagtatttggcaagtaagagttctgcatttgatatcctggtttacctggcacaacaaagtatctccaaattcattcattcattctttcattcattcgataggtatttactgaacatctaacttatgcccaacactgtgctgagagatatgagataaccatgaatagtacaaaagcaatccctgcccttgaagagcaaacagccaaatatcaggagacaggtaacacacaaggaaatgtacaagaaagttgagccagcacttttataagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggattttaaccatt

SEQ ID NO: 27996 - DNA, 2042 bp, Homo sapiens
attccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccagggcccttgcggatgtcatgagaccacagggccactgcaacactgatcacatggagagagacctaaacatcgttgtccacgtccagcattatgagaacatggacacgagaacccccataaataatcttcatgccacccagatgaacaacgcagtgcccacctctcctctgctccagcagatgggccatccacattcgtacccgaacctgggccagatctccaacccctatgaacagcagccaccaggaaaagagctcaacaagtacgcctccttaaaggcagtcggaagttctgatggtgactgggcagtatcgacacttaagtcaccaaaagctgacaaggtcaatgacgacttctacaccaagcgacggcacctggctgagctggctgccaaggggaacttacctctgcaccccgtaagagtggaggacgagccccgggccttcagccctgagcacggtcctgccaagcagaatggacagaagtcccgcaccaacaagatgcccccacatcccctggcctacacctctaccaccaactttaagggctgggaccccaacgagcagtccctccggcggcaggcttacagcaacaagggcaagcttggcacggccgagacaggctccagcgaccccttgggaactcgcccccagcactacccacccccacagccatacttcatcaccaacagcaaaacagaagtgactgtctgagctttcaccacagggagcaccctggagaccacactcaactgagagaggcaaaaaacaaccccgcccacaccctccccatcctcccctaatacatgcgtccacacactcactctcaacaagaaccaactctaaacctactggggacacagagtcgcgcttttcctaggtcatgcctgtaacgtgtcggcgggcagctgagaaagaccgaagcgtggacattcagcaatacagcaaaggggaaaatgaggcacactctttccacttcaggcccaagatggccaactcacatgcccaaaccgt

SEQ ID NO: 27997 - DNA, 4180 bp, Homo sapiens
ctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggctctatgacaatctgctgtttatggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcatttgtggttatcctaaggctttgaccagcttcccaggctggagaagtccatgtgtgcatgcatctactgttggccacagaaaagtcttaatttatttttctttgcagggtatgttgacttctctttgggcactgagtccttgcattttaaaaatcaacttcattgaagtataatttacacaataaaatgcacacattgtaagtgtgtagtttgatgagcttggacaaatgtctatacctgtgtaatcattactctagaaagctcactcatgcccattgcccttgcatttttgaaaaataattgatgcttcttgtgcaagaagaagtgctcaggaactctattcaagtgtttaaaagtcaacacatagattggacattgggatacctggaggctttgaagcaagataccgggactctgagttctgtttggaaatattggtgtcatatatttgtcattgtaattggaaagaaaagagatgcaccattttcttcttgttctttggataagctaagctcattcccatcttggagctgttgcactggcccttgtgtggctggtccctcctcatcaccagggtcccagctccaatgtcatcttctctgagaagccgtccctgaccaggcttagttgcttcccaccccagcctgacacactccagcccatcacccagtcagtgttatttgcttcatttttacattatggtctaaaattaacttgctagtttactggtttactagtttattatctgtctccttccattatccctctccttccctccttcccttccccttccttccttccttccttccttccttcgagacacagtcgtactctgtcaccccggctggagtgcagtggtgtgatcttgcctcactacaacccctgcctcctgggttttagcgattcttctgcctcagcctcccgagtagctgggactacaggcacccaccatgatgccaggctaatttttgtatttttattggagacagggtttcaccatgttggccaggctggtctcgaactcttgacctcaagtgatccacctgtctcggcctcccaaagtgctgggattacaggcatgagccactgcacctggcccttttattattcatagtaagacacacagggaccacaattgtctcttctactcagtagttggattctgagtgcctagttcagtatttggcaagtaagagttctgcatttgatatcctggtttacctggcacaacaaagtatctccaaattcattcattcattctttcattcattcgataggtatttactgaacatctaacttatgcccaacactgtgctgagagatatgagataaccatgaatagtacaaaagcaatccctgcccttgaagagcaaacagccaaatatcaggagacaggtaacacacaaggaaatgtacaagaaagttgagccagcacttttataagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggattttaaccatt

SEQ ID NO: 27998 - DNA, 6726 bp, Homo sapiens
ctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccagggcccttgcggatgtcatgagaccacagggccactgcaacactgatcacatggagagagacctaaacatcgttgtccacgtccagcattatgagaacatggacacgagaacccccataaataatcttcatgccacccagatgaacaacgcagtgcccacctctcctctgctccagcagatgggccatccacattcgtacccgaacctgggccagatctccaacccctatgaacagcagccaccaggaaaagagctcaacaagtacgcctccttaaaggcagtcggaagttctgatggtgactgggcagtatcgacacttaagtcaccaaaagctgacaaggtcaatgacgacttctacaccaagcgacggcacctggctgagctggctgccaaggggaacttacctctgcaccccgtaagagtggaggacgagccccgggccttcagccctgagcacggtcctgccaagcagaatggacagaagtcccgcaccaacaagatgcccccacatcccctggcctacacctctaccaccaactttaagggctgggaccccaacgagcagtccctccggcggcaggcttacagcaacaagggcaagcttggcacggccgagacaggctccagcgaccccttgggaactcgcccccagcactacccacccccacagccatacttcatcaccaacagcaaaacagaagtgactgtctgagctttcaccacagggagcaccctggagaccacactcaactgagagaggcaaaaaacaaccccgcccacaccctccccatcctcccctaatacatgcgtccacacactcactctcaacaagaaccaactctaaacctactggggacacagagtcgcgcttttcctaggtcatgcctgtaacgtgtcggcgggcagctgagaaagaccgaagcgtggacattcagcaatacagcaaaggggaaaatgaggcacactctttccacttcaggcccaagatggccaactcacatgcccaaaccgtggggctgagttttcttttcctcctaacttgaaactgaaatccatggtgacaaaatataaaagtagcacaatttagagaaattgtccatttgagcacatacactacttgccacgtgctgtctgtttctaggttcgaaagccagggtggaaatgggggtagagaatgagggaggacacaagagaagagtgtattctggaagaggagttgttctgggaggaatttgcccacattagaagcatttttctaattccaagaagtggtgacgtggacgtaaaattttgacgagcatgaaacagtaactggaccccaaccattctatttatagtacttttcatatcatccatgttgaaagcaaaaaacaacacaccctcaaactcacagaaagtaaatagaccctgaacccaccgacaatgatgggaaggaaaaaacaaaaaacaaaaaacattttagagaactcccataaggaccatgaccgtggaaatgggagggatgggcttttacggagagggtccggagagtatcaaataactttttaaaaagaggattaaaatgtaagcccactacaaaacagataaaaacggcaaattaggtgttttttttttttcaaaaatcttgaagacttgttgacattaacaacaacaaatccacagttggaaaagtccacaggagatcagatgaggatccagaagcctctgatttctgggttttgcctccaagacctgaaacagccacagaaacaagtcctctataaactgtatgtccctgacatccctttcccttcagcgcgttgccgccgccgctgccaaacttcaactgctttggactgaaaatgtcataagcgtgggtggtgccttcaatgtgttactgttgtttaatgacagtcttgtttcccaagtgcaacctgtgttcttttagccttccttcctcttctttttctgcagtagtagaagatgtttccatccttcctttgtaggtgagcccaccccataacaccctctgaggggctgctacaatgtcaggggtacccaagaacgaagacctccctactctctacactatcaaaattagtccttccattttctagccctctcaaacctgtcagatgtttcttggtcccgtaattcccatggtccctccaaattacctccccacatacttcatgtgttcatctcccatccagaatgtcctgaggttgtttttctggttggttctcataatccatagtccttggggtcccagcaaagtcagttttcctacaagttgtgtttgttttgtggaagcccaaagaagtggattgagagagaagagatttttatctaaggtggaaggtttttcaactagcccctaaaggtctttggtagttaattaacattcaacagacccacagcaactctggtgtcagaagctataaatggtctggccaaacaagactcagagtattttctgaaatcctgagctgcaaggttctgcctcacctgtctctccactctgacatcacgaaatcagcaaaaccagatatttattctcctcactcccagcagatacgaggacaccaacaatgcagttgatccctctgggcctgagtctcccatctgaaacatggggaattggggtaggtcaagctttttgaaactgcaaaacctctacctgtttttaaaaatgagatcttttgaccaggcacagtggctcacacctaaaatcccagcactttgggaggctgaagcaggtggatcatctgaggtcaggagtttgagatcagcctggtcaacatggtgaaaccccgtctctactaaaaatacaaacattagctgggcatggtggtgggtgcctgtaatcccaactactcgagaggctgaggcaggagaatcgcttaaacttgggaggttgcagtgagctgagaccacaccactgccctctagcctgggtgacggagtgagactatctcaaaaaaaaaaaaaaaaagaaaaaaaaagagatctttcaaagaacgcataataggagatctccatgtataaaaaggtaccatgctgtacaaagctggggtcagagatttagtgcccaccttctcagcctccttgggaagaccccagagcttcccagagtcaagtaaataccactgggcatggtcagagtttccttgacgttaatgagctatgtacctgcaacacactttggcatctctgtatatcaccttcacaatatttgtatctaaattgattcattttaatgcattttgtttttaaaatgaaaacttcctgtcttcatcacaaatttaaaaaaaatcatcagttgccataaatagaaagcaaacataaaaataagtacaaaggaaacaagcagcgatgattaaattccagctggagtctgttgtctgtgagtctgaactaaagcctggggttctttctttctctctccatctctctgtttctgtttctctctctctcttaaaatgatatcatcaggtattaaataattgttaaaaataccagcacccaatgaagactttctctttgtactaataagatggaccaaaaagtaaatgaaaggggaatcatttcctatgcaagtcagtgttgaacaatgctgtagctatgtactgcctatgatcattgtgcatacactaggggtgcatagcccacacttcagaaaaccctgggttgacttatctgtgaggctctttccagctcaaagtttccataattcttatctcccttttacctcgtggttgctctttgcccccagtccacttcgtcccacccttatctcaactctgattaagagtctttcttggcctctaaatctgtagtattgtattccttctgcatgctccttctcctctgaataaacttcatcaattgaactgggctccttggggtctgcagttgtaattttggcagcaaaggtgcagactggtcattaagatgtagccacaatgatggcccaagaaggacacgtactttccaagtagtcctgtctaggatggaaagctcaggaagtgcttcatagtttattatcttccagttggttttgggagatgaactgaagagggaagtttggatagggaaggtctttttattcttttttttttaatgtatccatggagtatttattattattattattattattattattattattatactttaagttttagggtacatgtgcacaatgtgcaggttagttacatatgtatacacgtgtcatgctggtgtgctgcacccattaactcgtcatttagcattagctatatctcctaatgctatccctcccccctccccccaccccacaacagtccccagagtgtgatgttccccttcttgtgtccatgtgttctcattgttcaattcccatctatgagtgagaacatgcagtgtttggtttttttgtccttgcgatagtttactgagaatgatgatttccaatttcatccatgtccctacaaaggacatgaactcatcattttttatggctgcatagtattccatggtgtatatgtgccacattttcttaatccagtctatccttgttggacttttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggcgtgagatggtatctcattgtggttttgatttgcatttctctgatggccagtgatgatgagcattttttcatgtgtcttttgactgcataaatgtcttttgagaagtgtctgttcatatccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttcctcttgggagggtagacagacctcacaatatggaaagacgggacaacctatggaactatctgtgacttccatgtaccaagacaaggacgctatagctagggtagtgagacctagaagagagaaaccagaacaaagcagacaggctgtcctcttcctaattccatgccctgacatcagcccctattttttgcctttagctgtcccccagtttccaacccaatgggaccagagtctgacttccctttgccctttcacagtgtctcagcctccatctgccttgggctccgcctggcctccccatctaactcttcccagttttttgtgtaaatggagcatattttatgtgcgaatattttagtaaccgtatgttctgcaagtaaacctgtgttaatacttgtcaacaactgcagagtttatgatacgaataattcttcctacaatgaagaaaaaaacacatttgtttgttttctaagaatgtttatttgtaaacatatgtattcactatattaatatgaatttcttacctggcaataaaactgattatatgtg

SEQ ID NO: 27999 - DNA, 1951 bp, Homo sapiens
cgcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 28000 - DNA, 1351 bp, Homo sapiens
gtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 28001 - DNA, 3757 bp, Homo sapiens
cgcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggcttt

SEQ ID NO: 28002 - DNA, 1902 bp, Homo sapiens
gtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagc

SEQ ID NO: 28003 - DNA, 1513 bp, Homo sapiens
gtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaattattatggcaaaactgtctggactgctgacagtaaattccggtttgcatg

SEQ ID NO: 28004 - DNA, 2422 bp, Homo sapiens
ccgagttgcgaggggaggtaatttactcaaaacaagaggccgccgttaggaagtataaatagtgggacttcaagcgcagcgtcgctatcagatctgaactctccgcaggaagaattgtcaaagatcttaacattgaacaagcgcgctccggcagggaagcatcagttcccatttccctccggcagcccccgccccttctcttctcctcctcctcctccctctcctcttcacccttctccccctcttcctcttcttcctcctcctcctcttcttacttctttttctccttctacttctcctcctctttcttctttcttctcctctttttcttcttctttctcctcctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggaggtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatg

SEQ ID NO: 28005 - DNA, 3277 bp, Homo sapiens
cctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggagggtagaaggaagccaacgaaagctgaggtccaggctacgctgcttctcccgggcgaggcgtttcggtttcttgtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtctcctcccacccccttatctcccatgcactcactccattttcatcttcactatgaaaaacaataccaaaagtatctggaaattgatatatatatatccatatatatatatcatatatttgccatatatatatatatatatatatatatatatatatatatatatttgccctgtctttgatcctggggaacaaaagaaaaaagtcagaaagggaaaaaattacactcattgtcctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaaccttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttgatggggttcgagtcatctttgttcctgttactattaaaatatccgggatagtctttcc

SEQ ID NO: 28006 - DNA, 1171 bp, Homo sapiens
cctcctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggagggtagaaggaagccaacgaaagctgaggtccaggctacgctgcttctcccgggcgaggcgtttcggtttcttgtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtga

SEQ ID NO: 28007 - DNA, 4078 bp, Homo sapiens
aaagctagcctctagcgcagagtttgccgggagggagaaggggcagaggtggaaagcttaaccctccggtcgcctaggtgtttggggccgccaagacccctcgaactccgcagagcccctgaatctttggatcttaggggccaaaacttcccattctctttcaaggtagaaggaagccaacgaaagctgaggtccaggctacgctgcttctcccgggcgaggcgtttcggtttcttgaccggctcttccggaaatgatttttaacacccatgctggcctggatcctgcgctgggaagaactgcaaacagcctcgactatctaaactcagctttgacttcttaaaacccggagtctctgattcgggcgcagaggataaaggttccagggggatatatatatggtggctgtatatgctcacactagaagagctcctgtttttaaagggaggagaaggacaggaaagtggcaacggatgtgtgcaaacccagagcagaaaaattcatattttattaaacatccgagctgctggttgcatgaaaaggctttgagcaaccaatagaaaccgaggatcgcgaatattccgcttgaacctgttgatctctgtgggttaagcgtttagggtcgagtctgcgtttccacgagggagggcgaagagagaacagaaagagcggttgctttcgcccgccaccggaggctggttttccgcctcctgccttctggcccggcttgggcggcgagccctttgggcagccaacatggcgtgggcgcctgtgctcgtgcgaccccggtcgggcaggcgggacggagattacctggctgtccaggggaccttatgcagggtttggcccgagcccaggggcagcgaggggcgtctgcggatgcggctccctgtgcggcacaacaccggggtctgttgctctcgctgatacctttcggcccaattgttcctaaattagaccagcaagtttgcggtaggcagagagccagcggtggtgagagctggcctgagaacgagccagccttctgggaatggccggtgtgagaggccagtgggtggccttgccgcgcccttatgtccagactttgctctgtgagaggcctggcgctgcgcctttgatttctgtgagtgctgcggagcaagtgagtgcgaaagtgagtggaaaccatttggtgtttgctggggaaggccggtgactggggggtgaatagtgaggcggtgagtcgaggtacgtttgtgaaggaggtggtggatgactgcccaccttgccccaggcggccgctcagacttgacctttgcgcttctccgggatattcttcctccgggtgggttgagaagccggaccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtctcctcccacccccttatctcccatgcactcactccattttcatcttcactatgaaaaacaataccaaaagtatctggaaattgatatatatatatccatatatatatatcatatatttgccatatatatatatatatatatatatatatatatatatatatatttgccctgtctttgatcctggggaacaaaagaaaaaagtcagaaagggaaaaaattacactcattgtcctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaaccttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaatt

SEQ ID NO: 28008 - DNA, 2879 bp, Homo sapiens
gcgcgagcacttccgcctcgagccggaagctccgtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgcctgcccaaagaaacccctggccagcattttgaggggctgaacatgttaactgctcttctggcaccaagaaaatccaggacagcaaaaccacttgtggaagaaataggtgcttctgagattcctgaggaagtagttgacgatgaagagtttgattgggaaattgagcagacaccctgtgaagaggtatcagaaagtgctttgaatccgcagtgccactatggatttggaaacttacgatcaggagtgttgcaacggttacaggatgaactgagtgatgttattgatattaaggatccagatttcacccctgcagctgaacgaagacagaagcgcctggccgctgagctggccaagtttgatcctgatcattatctagctgacttttttgaagatgaggcgattgaacagattttgaagtataatccttggtggactgacaaatattcaaaaatgatggcctttttggaaaagagtcaggaacaagaaaatcatgctacattagtgtctttttctgaagaagagaagtatcagctacgaaaatttgtcaataaatcttatctgctggacaagagagcctgtcgtcaagtgtgctacagtttgattgatatccttctggcatattgctatgaaacccgtgtcactgaaggagagaagaatgttgaatctgcatggaatatcaggaaactgagtccaacactatgctggtttgagacttggactaacgttcatgatatcatggtgtcttttggaagaagggtgttgtgttacccactctatcgccatttcaagctggtgatgaaggcctacagggacactataaagatattgcaactgggtaaaagtgcagttttaaagtgtctcctggatattcacaaaatttttcaggaaaatgacccagcgtacatactgaatgatctctacatctcagactactgtgtgtggattcagaaagtcaaatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctgttataaataaagctgttatgaacatttgtgtac

SEQ ID NO: 28009 - DNA, 7447 bp, Homo sapiens
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggaggagcgagctgggctggaggcctcactcctggcatgccaccaagttctctgacagccaccccgagctagcggcctccccattcacctccaccagcggctgtccttcctggtccggccgacaccacgcgagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaa

SEQ ID NO: 28010 - DNA, 3597 bp, Homo sapiens
aaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtg

SEQ ID NO: 28011 - DNA, 2276 bp, Homo sapiens
gtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagca

SEQ ID NO: 28012 - DNA, 2365 bp, Homo sapiens
gtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcaaatgtgtgtagatttcatgctcgacacttaccactcacctatcaacagatcatcctgcttgactgtaacaaaataaatagtgtctcttc

SEQ ID NO: 28013 - DNA, 1862 bp, Homo sapiens
accctcggcgcgccgcgcgggatcagcgtcctccagccgcgctgccccggcccaccgtgcagctgtagccgcggcgcggtggcgcggtggcgcagggcgctgctgggccgcccattgttgagcgcgttgggccccgccggcgatgccgcgcgccgcctcctcggagcggcggcgaagtttgaacttggcgtcggcctggagccccgagcagcccgggggcggcggccgcgaggcgagcggcgatgagatgtgtgcacagacccaggccatgcagatactggtgcctctaacttcgtcagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagat

SEQ ID NO: 28014 - DNA, 11020 bp, Homo sapiens
gttattaactgtaagactgtttgaattgtcaggtctttgtggtgagctgaattctgcatggcagtgcttactgtgcagaaaggttgcaatgcctcactttgccttaatccatgttcctctaacttccttactctttctctcaagaggaggcaagtggctgtggcggccgcagcagtggctgatcatcactgaaaataccaaagaaaagaactgagctgcctccttcatattttttccattgaggattaatttaccgtgctttttcattttctctacatcctgcaaaagtttttttctctcctaagaaacaaactatgaactgattgttgaaaaaaagaagtaaaaagttttagcacagcttctctgtctcttcgggacaagttagaaaattctgaagtgagccgaagcatagtaagtgctttctttctttttaagctacttctggggagggaggaggctattgtaatggtaaatttcactccgagaggaagaaagggttgataatcaatcaaaaatgaggtattcctttgagtatttgtgattttcttactatattgtaagatgcttttaattttctctgtaaaataggcagaaatggttttagtgtgtgtatgtgtgaaataaaagctcagaaaagcaatcttcagagcgccactgaaggaagttttgacgaacggagtagagatgtataccacttgggggcttcagtgagaacccagaattcctggaggaggatttacattcagaaatgttgaagtgaaaattccttctggttcagcatcttggagttcagcttggaagaacattttacgtatggaagaatttgcttctccaaacctctcttttggccattgtgtgtcctgaaggatgggacaacttgtgctgtagaagcactgcttgcctgagtttgcttcaggcattttaaatttaacttgagggatcatgtgtttggcatgatgaggaccactgaagacttccacaagcctagtgccacattaaactctaacacggccaccaagggaaggtacatttatctggaggcattcctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctggccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacccggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagatagtcacgttgagcgtgaagactttttttcttacattcctgtcttatttttaccaacacgagcaggcattctgcgcttccactggactgagtatgggggagtcctgctcccctcctgtctcacaccttccccaggaggaaggcctcatgcactgcggttattgcatcatttcctagtgcttcatgtcattatcactggtggggaaacaaagctaaattttattaacaaagacaactctcagacctatataataggaggaggacgtccagaatccaacaaaattcaaacggagcccatgctgttctcctgaacaagatttgggctaaatacggcctgtttattgaggctgttttaatgatgctttaaaaaaaaaaaatgttttctaaaatgtcaaacctgttgaccacactttgattaaaaactgcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagccagtcttagaaaattgggggagtaaaattttgaagtaaaaaaaaaaaaaaaatgacaagggaaccaaatgctccttctccccttagtacattttcattacttaatgaagttttatctcctatgtaagaatatcaaaattgtagtttgggtctccagtagagatgtcttttgattaacttataaacaactggccacccagaagtttcctttgcatagtcaaccaaagctatggctttgttctttggagcttatatactgcatgactccattgatacaaataagacagcaccttggtttcccagggatgttttcattcagaggtcctgtctcccaggaaagcagtagaaccagtgacagcattcaacagccacactgcatggtcatcagtcttaggccaacatgggagcctgaaattaactccatcagtaactacctgtgtgtcttgctgatactgaatgagccctcacaagccaagccaggtggaagacagccagcaaacgtctacagttattcttagtgaaattcctcagaggaatccagggggctcccagttcccaacactcttcgagatgaccatttttcgggatttgactggggaacattttacatattcagtctttctcaaaaatttttatttattttcttgagaaagggtcttactatgttgcccaggctggagtgcagagtggtgcgataacagctcattgcagtctgaacctctgaggctcaagccatcctcccatctcagcctcccaagtagctgggaccacaggtgtgcaccactatgcttggctaattttttgattttttatagagacgggggtctcgctatgttgcccaggctggtttcaaactcctgggctcaagggatccttccgctttggtcccagaagtgctgggattacaggcatgagccacttcacccagccacttttctaatttatagacataaaagtaattgactcccacagcacagtaacaggcaatgctgcttggcatgccacaaacatctgaaagcttgtgacactcctaggattgtgtccattctttcattatgtggaaactttgttctgttatgtgaaatgggtaaggcaccaagtgagactttgaaatctaatttttaggtggatgtgatatttattgtaataggacttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgttttgtttcttgcggtggccacttaaccccaaagaatgaagggaggatccacagtgaaagtgcctgagtttctctatgagaccagatgctgtcgaaaccaaacatcttttcctttgctctatgggaacattttagggtttgttttgcacagctggtttccagactagaagattaacaagtttgggtccacccctaagaatcagtggctgtcttttaaggtgaggagtgtgggcttaactgaggtcctttgagggagctataaaggagaaacaacctgggacatcccagttttcctattcctccactgttaatatctcatctaaaataattcatgagtttaaatggtaaatatatgctttaagctctacctttaaacttgtatgttattcaggcatctcttattaagatactgggtctctggatacccaaggaaatgttggctttttattcttatgtggttccaaatttacttctcttcagtttaattgtccatggtagtgctggcttcattgttaggttggagttattattttccttttagaacaacatgaattttattcaccttactattagaaaaaggaataactacagccagaaataacttcatttcctacaaggtataaaaagtggtcaagtgaatgtgaaggggcttttctacacaggaatatattatcgggaacaaagtatttcctgctgccttaactctttgggatgcataggataaaatgataaagaccattttaatatcagaaagggttgtcttattaatttttaaataaaacttcacatttcttaatggggagctcattcagaaactaaataatggtttctcaaagtgtggtcaggatacgatctgcatcagaatccttggaatgcttgttaaaaataccaattgctatgacaaaaccaagtctgctggaaactgcatttcagcaggtttcccatgttattctgatgtattttaacatttgagagccactaccaatcatctgtacagttcctactgttatgatcacaataagactaacatgaatttaataatctgaataatttttaaaatttaaataaacagaaattgaagttaaatttaaaaataaaaataacctcagaagttgaaa

SEQ ID NO: 28015 - DNA, 2241 bp, Homo sapiens
gcattctatcatcagatgattttccttgcttccctcctcctcttgcccacaaaaatagaattccagcatttctaagctataggctattgttcaagatgccagctcttctcagggagtcattaagggtcaccttctcttcttccctcttacagagcaggaattgaattttaattggccaatttacagaggggactggcattgagagtccctcccacttgcgctgagctgggcaagttcaaggcgattcaggccgtccaactggaggcacatgtagtacttgtgaggcttttaccatgctgtggggagcagaaagagcagtagcagggcagaatggctttttattccacgactgaatatgacatccaattggccagagggttgctatctgggatgtttctatttgccacaaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgtatcagagctgctctggcagagaggccctcagagctcggtgctgggaaaggagcaagtggaagtggtgagcgtggccaacgtcttgccaagactgagaggggaagggctttgtaaggaggagagcctagagaaatagattcgtgtactacactgacccttacctctgaggcattaaggtgggtgttggcgcaaatcctgaaaatcaggaaaggtctgagtaggagcgcactgtctggtttggcccagtccgtgagcctctgcttctgaagctccttgagccagccatgtaacacgtgtcccagtgtgcagtctgtgcttttcatttctcctgggttactgcagtattttcttgcatgttttatttccttaaaagactactatgagaaagactgagtagctttcattttctcttaaattttcagtgaaatctttgtggattgacagtctgggactcagcagttagtggcttccagactaaataaaaacagaacattttatccaaatttgggattgcattttaaaaatttccaactgatcctaactaaattactaacaggaacaccacgtttcattttatgggggagagagaaaggaaagagctatgtgatacttacaagctatttgtcacattgtcagaggctcttctgattcaaggccttaactgtcaccttgtccatttcactgcttttattttcagatttgggaaacagactaattgaggtgaagtgatttatccagggtcatgtctttagcaaacacatactgagcacctacaatgtgcaaggcaatccactgggtactatggggaccccaaagataagatttttgtaggtgtgccagtcagttcaccatgggtggttgcagtatggtcattctgttctctgaccactggctgaaggaccaaagtaacatccttagcaaagtatttcctagcattaccactggaaatatatgtttgctccgtcagtttagaagcagaatggtcatggagcttttgcagcactgagaccttcctggggattt

SEQ ID NO: 28016 - DNA, 6261 bp, Homo sapiens
ccgttttcttgtccattacgcgctatccctccgcctctccttctttcttttcttttctttttttcccttctccttttcccccctctctccccctttctccagctccgtgtcatttcctccttgcgctcgctcgctgcctgagcgtctccagccgggagagtaggcggagcagggcggtgcggggtggcgtagagctggagggcgatggtggcggagctgctgggggcggaggcaacgtagccccctcggaaaaggagcccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 28017 - DNA, 9556 bp, Homo sapiens
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttgaaaataataaataaaagccactaacaatccaagaagttattaggcagaatcccaggcccaccccaaacccagtgatagcagtctgaattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 28018 - DNA, 7966 bp, Homo sapiens
ctttcatccttccctttgccaccagggtgctggctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaa

SEQ ID NO: 28019 - DNA, 2338 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 28020 - DNA, 1531 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 28021 - DNA, 1298 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattctt

SEQ ID NO: 28022 - DNA, 1935 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaat

SEQ ID NO: 28023 - DNA, 2587 bp, Homo sapiens
tctgcctgcgacggtggtgttgggtgcatcctgcgccacgtgaccgcctcccagccaaccaatggaggagcgaggcggaaaatttcgaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataa

SEQ ID NO: 28024 - DNA, 1075 bp, Homo sapiens
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagagg

SEQ ID NO: 28025 - DNA, 1582 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 28026 - DNA, 1969 bp, Homo sapiens
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccactacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 28027 - DNA, 1213 bp, Homo sapiens
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 28028 - DNA, 1128 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaat

SEQ ID NO: 28029 - DNA, 1187 bp, Homo sapiens
agttccaggcgacggcggacggtggtacggtcctggagggcccagtgcgcggggctagccgtggctggagagcttcgaagagccttgaaatgtgaggaggaggaagatagctgttgcagaagtagtggccaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagatcagatacctactattcctcaagacacactgggagttgattttgattcagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataa

SEQ ID NO: 28030 - DNA, 2261 bp, Homo sapiens
gaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataaga

SEQ ID NO: 28031 - DNA, 1162 bp, Homo sapiens
ctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcaccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcagaaccaggaaatatgttcctctggaatggaccccaatagtgatgacagctccagaaatttatttgtgaaggatttaccgcaaattcctcttgaagaaactgaacttccaggacaaggagaatcatttcaaatagaagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgaaactgagaagaggggacccttttacagatttgtgttttttgaattctcctattttcaagcagaaaaaggatttgagacgttctaaaaaaagagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttggggg

SEQ ID NO: 28032 - DNA, 4214 bp, Homo sapiens
aaccgccaacggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaataaata

SEQ ID NO: 28033 - DNA, 1041 bp, Homo sapiens
ggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagaggtgagattgttttaaaaattcattttgagtatttgtattagttacattcatcagatgttcttcctgagggcaattatgtataacagttaataagttagctctcttatgttaccgatttgctaacttctgccatttaaaactgctggtgatagatttaattttaaagtaaatatgctgacaaacatcacacccacagtggcctaatactgttactctggaagaaatatttagaaataaatggacctaatga

SEQ ID NO: 28034 - DNA, 640 bp, Homo sapiens
gacctgcggcccgccagaccctcggcgcggccgccggacgccgcggggcggacgcggaagtgaacgccttctcagctgctcggcaactcgggagcagagcggccccagcggcgcccccgtgcggcccggctctgaggcagcggctcagggagggagggaggccacgtcccgggcacgccacgccacgccacgccccgcccccagattcgtctcgccccagtgggccgcctcggagtcgggtgggtcttccatcccggaggacccgattggctgatggggcaaccgccaacggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagaga

SEQ ID NO: 28035 - DNA, 1631 bp, Homo sapiens
gtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagacaa

SEQ ID NO: 28036 - DNA, 5583 bp, Homo sapiens
aaaaaaaaaaaaaaactacggcggccgagaaggggcgagtacagcccagtcctgaggtcgcgggaggctgcgaggactgcaaaagggtggagtcggcctcgcccccgcccaggccccgcccctgccgggaacccactttcccagtcctaggcggcggtcagatccttgcaagcatggtcgcgccggggcttgtactcgggctggtgctgccattaatcctgtgggccgacagaagtgcaggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactagtgatgtgtatgtatttatatccacttgcaaactgtccttgaagcatgtgaaaaggagtaagaatactatctatgggtagctttcctccccttaatgtgaaaaatgagaactaaagcaaaaagcatcactcactgtacatatacaatgtattttacgtagtgtaaaaaatatggtttagatagtgaatatattaatgaaatcatatgtaaatttatttttagtggctgaataatttaaaacattatgtggaattcactatgtttcccccaatttaggaactttttactgtgtgaaaatgaaatttataatactctgtagggtgaatgatggtttttgctttagttctacccctctgtagagttccaaggggttctggtgtagctccaaacagcaggaataactttgtcagtgccaagattttatttagttaaaaaacaaaaaatctacacactttacaaggaacgttggctcccctgaggacttcctagcattcaactcgttcagttaacccctattgcccatgctttgacctctcatgcatctggccccatagaaaccatgaaccttgtaacagattgatgcctgagaaaaagtcaatctacccgtccactcctccactcccaatacacatacccccatgggctgttctaattcgggggcagccagaggtagccaagaactctaagtccagattcctttcacctccaggaacctagagtacatagtgtgaaaaatacggttcaggcaatgattatgttaatgacgccatgcacattcatttttagtggctgagtaatttaaaacatgatgtgggaattcactgcatttccccaaatgtaagaactttttagttttaaaatgaaatttatagtcactgtagaaaatttggacactaaagtataagcaagtaaaaatcacccccaaattcatcattcagagaaacactattttgctgaaccattcacttgacttgagttatataattttatacagtacatattattttgtaatctgtgtttttgacttacttactttaccaaaataattttcttatgtaaataatagaatatagatttagagtgtttcagtttgtggaagcctcattttatttaaccaatttcctattaatggacatatagatttttaacaattttctactattaaaataatactgtaatgaatatcacatgcaaacatcataccacactcgtccagttatttcttagggttcttaacatggaagaggataaatatatatttaaaatttagatatctacagcttaaccctcccaaaggattaaacaacttacattctcaccaaggtagtcctttttttgccctcaccctcattgacactggatgttgtcaaatttaaaaaaaatccttaacaatctgatagatgaaaagatagtttaagtatactaaggcagtgtttttcaaggtgtttttgtttttgtttttgagttggagttttgctctgttgcccaggctggagtgcagtggcgcggtctcggctcactgcaacctctgcctcccgggttcaagcgattcttcctgcctcagcctcccgagtagctgggactacaggcgcgtgccaccacgcctggctaattttttgtatttttattagagaccgacttagccaggatggtctcgatctcctgacctcttgatccacccgcctcagcctcccaaagtgctgggattacaggcgtgagccaccgtgcccagcttttcaagtttcttaaatccatgatccatagtaaaaacattttacacatatcttcatacaagtatatgtatatgtggtatacgtacacactatagttgtatatgcattatagctgaaaaaccagttcaacctttctacatgtggtatgttccaaaaattttaaatgtctttctaaaatgaggctcttttaatacgggtattactcaggctgtaatagtgggaaaatatttgttatatgataaaagcagcatatatcatttctgtgtaaatgccagtatgctcaagccatttatgcagagaaaaaaagaaaaacactgcattaacattttaagcagtccccttcccgatttgctattatacaaagtttgtttcttttacattgtaaagtgtatacaacttataaaaagactatactcaaaatcataaaataccagttaacttagcttctcagtttacagtggccagtgtggtgtgctctaaacactgctgcctgatccctccctctgctggtcagatttattactataaagtaccaatcccatttgtgttgtcctcaattggcaattatgaatggcagtgcattaaccattcaattctcaccactccatccccattcttctacttctgggtccttttgtccctccctttccagacagcccttggtaacctgctgctgggtaactaaggcatcccacaggtagtgttgaggtgttaggtgatagagtaaacctctaccttaatgctattaacagggtccaaaaatccagttgcatggaacatggagttatattattacatggctaatgaaaagacaggactaagtctgttatagagtatgggactaacccccaattatatgtgaatttgtgttatcatatggtttcagtgtactgagctaaaaagcacattatctgaggtgcaatacaaaggttaaagaggttaaagatcccc

SEQ ID NO: 28037 - DNA, 2884 bp, Homo sapiens
actacggcggccgagaaggggcgagtacagcccagtcctgaggtcgcgggaggctgcgaggactgcaaaagggtggagtcggcctcgcccccgcccaggccccgcccctgccgggaacccactttcccagtcctaggcggcggtcagatccttgcaagcatggtcgcgccggggcttgtactcgggctggtgctgccattaatcctgtgggccgacagaagtgcaggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcact

SEQ ID NO: 28038 - DNA, 2247 bp, Homo sapiens
ggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctag

SEQ ID NO: 28039 - DNA, 3109 bp, Homo sapiens
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctta

SEQ ID NO: 28040 - DNA, 2997 bp, Homo sapiens
ggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 28041 - DNA, 2859 bp, Homo sapiens
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 28042 - DNA, 2126 bp, Homo sapiens
ttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagag

SEQ ID NO: 28043 - DNA, 1960 bp, Homo sapiens
agcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctact

SEQ ID NO: 28044 - DNA, 2664 bp, Homo sapiens
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 28045 - DNA, 1776 bp, Homo sapiens
actcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagag

SEQ ID NO: 28046 - DNA, 3173 bp, Homo sapiens
cgaggctcctcctctgtggatggtcactgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactaccctccacagctgctgggcccctcctgctcctgggaggctgagggtctgcactgcagctgctcctcccaggccagcccggccccctctctgcgctggtggcttggggaggagctgctggaggggaacagcagtcagggctccttcgaggtcacccccagctcagccgggccctgggccaacagctccctgagcctccatggagggctcagctccggcctcaggctccgctgtaaggcctggaacgtccacggggcccagagtggctctgtcttccagctgctaccagggaagctggagcatgggggaggacttggcctgggggctgccctgggagctggcgtcgctgccctgctcgctttctgttcctgccttgtcgtcttcagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccagagtccagtggtgcaatctcagctcactgtagcctcaacctgccaggttgaagtgagcctcccatttcagcctcccaagtagctgggactacaattgtgagccaccatgccaggctcattgttatatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacatttaaaaaaaaaaaaaaggctgggcatggtggctcacgcctgtaatctcaacactttgggaggctgaagtgggtggatcacaagtcaggagttcaagaccagcctgggcaagatggtgaaaccccatctctactaaaaatacaaaaattagccgggcatggtggcgggcgcctaaaatcccagctactcgggagactaggcagagaattggttgaacccgggaggtggaggttgcagtgagccgagatcgtcccactgcactccagcctgggcaacagagtgagactctgtttctaaataaataaatgaataaataaa

SEQ ID NO: 28047 - DNA, 2875 bp, Homo sapiens
cgaggctcctcctctgtggatggtcactgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactggaagctggagcatgggggaggacttggcctgggggctgccctgggagctggcgtcgctgccctgctcgctttctgttcctgccttgtcgtcttcagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccagagtccagtggtgcaatctcagctcactgtagcctcaacctgccaggttgaagtgagcctcccatttcagcctcccaagtagctgggactacaattgtgagccaccatgccaggctcattgttatatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacatttaaaaaaaaaaaaaaggctgggcatggtggctcacgcctgtaatctcaacactttgggaggctgaagtgggtggatcacaagtcaggagttcaagaccagcctgggcaagatggtgaaaccccatctctactaaaaatacaaaaattagccgggcatggtggcgggcgcctaaaatcccagctactcgggagactaggcagagaattggttgaacccgggaggtggaggttgcagtgagccgagatcgtcccactgcactccagcctgggcaacagagtgagactctgtttctaaataaataaatg

SEQ ID NO: 28048 - DNA, 2479 bp, Homo sapiens
atggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactggaagctggagcatgggggaggacttggcctgggggctgccctgggagctggcgtcgctgccctgctcgctttctgttcctgccttgtcgtcttcagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccagagtccagtggtgcaatctcagctcactgtagcctcaacctgccaggttgaagtgagcctcccatttcagcctcccaagtagctgggactacaattgtgagccaccatgccaggctcattgttatatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacattt

SEQ ID NO: 28049 - DNA, 2121 bp, Homo sapiens
gaagaaccctgaggaacagacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgta

SEQ ID NO: 28050 - DNA, 2498 bp, Homo sapiens
gtgcgcgtccacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcagatggaattagagaggtgggctcaaatctaggccctggcactgtcatcaagcaattcactgcatccctctgtgcctcagtttcccattctgtaaatcagagatcatgcatgctacctcaaaggttgttgtgaacattaaagaaatcaacacatggaaatcaaccaacatgggtcctggaacagggcgttgtgctcagtgctttctggtctctcttccttgaatagaaaggtcctgctggcaagttctctcaaggctggggatgaccaggcacaaaaaacagggcagcaatatgttggtgtcactccccttcccaaaactcttcgaagactccctaggaaagaccagcccctcagcctggcacttggttcatgatgtgggatcttatatccttgccagagtcatatctttgcccacttttacctgcaatccttgcatcatattcctttggctccagtccttcatttatgagacccataggaatccttccaacagccaaagagttgagtctaactctttcctgcccaaacccattcacggccccctggccttagacaatatatcaca

SEQ ID NO: 28051 - DNA, 2086 bp, Homo sapiens
cacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcagatggaattagagaggtgggctcaaatctaggccctggcactgtcatcaagcaattcactgcatccctctgtgcctcagtttcccattctgtaaatcagagatcatgcatgctacctcaaaggttgttgtgaacattaaagaaatcaacacatggaaatcaa

SEQ ID NO: 28052 - DNA, 1746 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 28053 - DNA, 1940 bp, Homo sapiens
cgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatgccagc

SEQ ID NO: 28054 - DNA, 2074 bp, Homo sapiens
gcgggacacagtctcttctcctctgctcttctttgggcaggtctctgggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatggactatataaataccttcgtatatatggcagaccacaggacttctgtccaagagaactgagttcaactccatctatg

SEQ ID NO: 28055 - DNA, 1870 bp, Homo sapiens
aaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcca

SEQ ID NO: 28056 - DNA, 1811 bp, Homo sapiens
gtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctggatgttgaggcggccacctctttccaccccagatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 28057 - DNA, 1713 bp, Homo sapiens
aaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccaggaagcctccgcctcagagatgctaccgctgctgctgcccctgctgtgggcagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggaaaccagaaggcagggctggtggtgtcctgggagcagtctggggagctagcatcacaaccctggttttcctctgtgtttgcttcatcttcagagtgaagactagaaggaagaaagcagcccagccagtgcaaaacacggatgatgtgaaccccgtcatggtctcaggctccaggggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 28058 - DNA, 1475 bp, Homo sapiens
gcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 28059 - DNA, 1754 bp, Homo sapiens
gcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 28060 - DNA, 713 bp, Homo sapiens
atgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaa

SEQ ID NO: 28061 - DNA, 2948 bp, Homo sapiens
agtttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagccctgacccataggcctgacatcctcatcctagggaccctagagtctggccactccaggaacctgacctgctctgtgccctgggcctgtaagcaggggacaccccccatgatctcctggattggggcctccgtgtcctccccgggccccactactgcccgctcctcagtgctcacccttaccccaaagccccaggaccacggcaccagcctcacctgtcaggtgaccttgcctgggacaggtgtgaccacgaccagtaccgtccgcctcgatgtgtcctaccctccttggaacttgaccatgactgtcttccaaggagatgccacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcagtaggtcaccagggctccctcctcctgtctaaccaaaacttggaccaatgtctcccctttccccggctaccagggacccatccctgcctctagcttctactacccaccattctcctctcgacctctctgaggttgactattttagattccacatagagatgaggtcatgtggtacttgcctctctgtgtgtggctcattttacacaaaaaaatatcccctaggttcatccatgttctctcaaatgacagaatcaagcactgaatatttttttttctttgagagatggagtttcgctctgttgcccaggctggagtgcagtggttcaatctctgctcactgcaacctccacctcctgggttcaaacgattctcctgcctcagcttcccaagtagctggtactacaggcgtgtgtcaccacgcccagctaatttttgtattttttagtagagacggggtttcactataagtgggccaggctagtctcaaactcctgacctcaagtgatctgcctgccttggcctcccaaagtgctgggatttcaggcatgagccaccgcacccagcttgcattgaatattttcaaggagctaaaagaagattttaaatggtctcacaaaaacagataaatatttgcacagatgggtgtgctaatcattgtgccttgatggttccacgatgtatccgggtgtggaaatctcactgggtctctctcaaggccactcggctactcaggacagggctggaatttaaagcctgtccgattctgaggtctcttctctcatctagcactgagtcaagcaatcagcaggctgggcaccccttagccataagttttcaggaaataaattccttgagggcattgacttttacaaaagagggagcagcaatggcctagagtctcaggaacaagacaggtgcactgaggagatgaaggccgggaccccctgcccaacctgtatggcgggtctgtacttattttgtttacccccaatttaaaacgtttttttttattgcaggttgtttgtttgatatggtttggctgtgtccccacccaaatcttatctagaattgtaatcagaattataatccccatgtgttgggggagggacctggtgggaggtgataggatcatgggggtggttcccccatgctgttctgatagtgagtgagttatcacgagatctgatggttttgtaagtggtggtttcccctgctcttctctcttgcctgccaccatgtaagatgtgcctggttccccttccgccatgattgtaagtttcctgaggcctcccccgccatgtggaactgtgagtcaattacacctctttcatttataaatt

SEQ ID NO: 28062 - DNA, 2669 bp, Homo sapiens
agtttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagaccctccttggaacttgaccatgactgtcttccaaggagatgccacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcagtaggtcaccagggctccctcctcctgtctaaccaaaacttggaccaatgtctcccctttccccggctaccagggacccatccctgcctctagcttctactacccaccattctcctctcgacctctctgaggttgactattttagattccacatagagatgaggtcatgtggtacttgcctctctgtgtgtggctcattttacacaaaaaaatatcccctaggttcatccatgttctctcaaatgacagaatcaagcactgaatatttttttttctttgagagatggagtttcgctctgttgcccaggctggagtgcagtggttcaatctctgctcactgcaacctccacctcctgggttcaaacgattctcctgcctcagcttcccaagtagctggtactacaggcgtgtgtcaccacgcccagctaatttttgtattttttagtagagacggggtttcactataagtgggccaggctagtctcaaactcctgacctcaagtgatctgcctgccttggcctcccaaagtgctgggatttcaggcatgagccaccgcacccagcttgcattgaatattttcaaggagctaaaagaagattttaaatggtctcacaaaaacagataaatatttgcacagatgggtgtgctaatcattgtgccttgatggttccacgatgtatccgggtgtggaaatctcactgggtctctctcaaggccactcggctactcaggacagggctggaatttaaagcctgtccgattctgaggtctcttctctcatctagcactgagtcaagcaatcagcaggctgggcaccccttagccataagttttcaggaaataaattccttgagggcattgacttttacaaaagagggagcagcaatggcctagagtctcaggaacaagacaggtgcactgaggagatgaaggccgggaccccctgcccaacctgtatggcgggtctgtacttattttgtttacccccaatttaaaacgtttttttttattgcaggttgtttgtttgatatggtttggctgtgtccccacccaaatcttatctagaattgtaatcagaattataatccccatgtgttgggggagggacctggtgggaggtgataggatcatgggggtggttcccccatgctgttctgatagtgagtgagttatcacgagatctgatggttttgtaagtggtggtttcccctgctcttctctcttgcctgccaccatgtaagatgtgcctggttccccttccgccatgattgtaagtttcctgaggcctcccccgccatgtggaactgtgagtcaattacacctctttcatttataaatt

SEQ ID NO: 28063 - DNA, 1528 bp, Homo sapiens
tttctgagagaagaaccctgaggaacagacgttccctggcggccctggcgccttcaaacccagacatgctgctgctgctgctgctgctgcccctgctctgggggacaaaggggatggagggagacagacaatatggggatggttacttgctgcaagtgcaggagctggtgacggtgcaggagggcctgtgtgtccatgtgccctgctccttctcctacccccaggatggctggactgactctgacccagttcatggctactggttccgggcaggagacagaccataccaagacgctccagtggccacaaacaacccagacagagaagtgcaggcagagacccagggccgattccaactccttggggacatttggagcaacgactgctccctgagcatcagagacgccaggaagagggataaggggtcatatttctttcggctagagagaggaagcatgaaatggagttacaaatcacagttgaattacaaaactaagcagctgtctgtgtttgtgacagcatccacagccctgggaaatggctcatctctttcagtccttgagggccagtctctgcgcctggtctgtgctgtcaacagcaatccccctgccaggctgagctggacccgggggagcctgaccctgtgcccctcacggtcctcaaaccctgggctgctggagctgcctcgagtgcacgtgagggatgaaggggaattcacctgccgagctcagaacgctcagggctcccagcacatttccctgagcctctccctgcagaatgagggcacaggcacctcaagacctgtatcacaagtgacactggcagcagtcgggggagctggagccacagccctggccttcctgtccttctgcatcatcttcatcatagtgaggtcctgcaggaagaaatcggcaaggccagcagcgggcgtgggggatacaggcatggaagatgcaaaggccatcaggggctcggcctctcagggacccctgactgaatcctggaaagatggcaaccccctgaagaagcctcccccagctgttgccccctcgtcaggggaggaaggagagctccattatgcaaccctcagcttccataaagtgaagcctcaggacccgcagggacaggaggccactgacagtgaatactcggagatcaagatccacaagcgagaaactgcagagactcaggcctgtttgaggaatcacaacccctccagcaaagaagtcagaggctgattctcatagaacaagaaccctctagagccccatgctatgcaatgtgcctggttccccttccgccatgattgtaagtttcctgaggcctcccccgccatgtggaactgtgagtcaattacacctctttcatttataaattactcagtctcaggtatttcttaatagcagtgtgaaaacaggctaacacattgttctttgaaatttaaaaatagcgttagcttttcagttgaatcacgcagctcttacatgtgccatgccatgagtgttgccaaacatgcacccctgtgtaa

SEQ ID NO: 28064 - DNA, 1689 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattcct

SEQ ID NO: 28065 - DNA, 1572 bp, Homo sapiens
agttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcagatcttgaatcattttattggatttcctacattccttggactgggtttcgagtttctcctgaatctccgtgatctttgttgccatccagattctgaattctatgtctatcatttcagtcatttcagactcattaagaacattgctggggagatagtgtggtcacttgaaggtaaaatactctggcttttggatgtgtcagatttctttcactggttcttcctcatctgtgtgggctgatgttcctttaatctttgaagttgctgttctttggatagggctctttgcttttatattctctgatg

SEQ ID NO: 28066 - DNA, 2045 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 28067 - DNA, 2045 bp, Homo sapiens; identical to SEQ ID NO: 28066

SEQ ID NO: 28068 - DNA, 2071 bp, Homo sapiens
gagctacttgaagaccaattagagtccgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 28069 - DNA, 2045 bp, Homo sapiens; identical to SEQ ID NO: 28066

SEQ ID NO: 28070 - DNA, 2045 bp, Homo sapiens; identical to SEQ ID NO: 28066

SEQ ID NO: 28071 - DNA, 2045 bp, Homo sapiens; identical to SEQ ID NO: 28066

SEQ ID NO: 28072 - DNA, 2045 bp, Homo sapiens; identical to SEQ ID NO: 28066

SEQ ID NO: 28073 - DNA, 2045 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacaggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttga

SEQ ID NO: 28074 - DNA, 1143 bp, Homo sapiens
atggcgtcccttcctgtcctgcagaaggagagcgtgttccagtcgggagcccatgcctacagaatccctgccctgctctacctgcctgggcagcagtccctgctggccttcgcggaacagcgggcaagcaagaaggatgagcacgcagagctgattgtcctgcgcagaggagactacgacgcacccacccaccaggttcagtggcaagctcaggaggtggtggcccaggcccggctggatggccaccggtccatgaacccatgccccttgtatgacgcgcagacggggaccctcttcctcttcttcattgccatccctgggcaagtcacggagcaacagcagctgcagaccagggccaatgtgacgcggctgtgccaagtcaccagcactgaccacgggaggacctggagctcccccagagacctcactgatgcggccatcggcccagcctaccgggagtggtccacctttgcagtgggcccggggcattgtttgcagcttcacgacagggcccggagcctggtggtgcccgcctacgcctaccggaaacttcaccccatccaaaggccgatcccctctgccttctgcttcctcagccatgaccatgggcgcacgtgggcgcgagggcactttgtggcccaggacaccctggagtgccaggtggccgaagtcgagactggggagcagagggtggtgaccctcaacgcgagaagccacctccgagccagggtccaggcccagagcaccaatgacgggcttgatttccaggagtctcagctggtgaagaagctggtggagccgccgccccagggctgccaggggagcgtcatcagcttccccagcccccgctcggggcctggctccccagcccagtggctgctctacactcaccccacacactcctggcagagggccgacctgggtgcctacctcaacccgcgacctccagcccctgaggcctggtcagagccggtactgctggccaagggcagctgtgcctactcagacctccagagcatgggcaccggccctgatgggtcccccttgtttgggtgtctgtacgaagccaatgattacgaggagattgtctttctcatgttcaccctgaagcaagccttcccagctgagtacctgcctcagtga

SEQ ID NO: 28075 - DNA, 3519 bp, Homo sapiens
tttccttttattggcgtttgtaaaatttcttctttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaa

SEQ ID NO: 28076 - DNA, 2468 bp, Homo sapiens
cccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacag

SEQ ID NO: 28077 - DNA, 2049 bp, Homo sapiens
agagaggaggcggccgttgggaactgagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacag

SEQ ID NO: 28078 - DNA, 1632 bp, Homo sapiens
cttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatag

SEQ ID NO: 28079 - DNA, 6854 bp, Homo sapiens
gcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttgg

SEQ ID NO: 28080 - DNA, 1935 bp, Homo sapiens
cctctgagcccagccctccctagcatcaccacttccatcccattcctcagccaagagccaggaatcctgattccagatcccacgcttccctgcctccctcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctcca

SEQ ID NO: 28081 - DNA, 1197 bp, Homo sapiens
cctttccccttggggccctgtccttcccagtcttgccccagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctcc

SEQ ID NO: 28082 - DNA, 1656 bp, Homo sapiens
ctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 28083 - DNA, 1479 bp, Homo sapiens
atgcagtgggccgtgggccggcggtgggcgtgggccgcgctgctcctggctgtcgcagcggtgctgacccaggtcgtctggctctggctggggctggaccacgagctggccttctctcgtctgatcgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcc

SEQ ID NO: 28084 - DNA, 1743 bp, Homo sapiens
ctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcca

SEQ ID NO: 28085 - DNA, 840 bp, Homo sapiens
ggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgt

SEQ ID NO: 28086 - DNA, 3148 bp, Homo sapiens
gcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattg

SEQ ID NO: 28087 - DNA, 2258 bp, Homo sapiens
ggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaaggtcagcatgtggagctgtgtgggtgcccctgcctgtactggcctggccaagagcctccgtgtgcttgcatagccgggcccagggctgggctgaacgggggccacgtgtagctgtgggaaaggacacgtggcaatcatttgctttgctgttggagaggccaggaagagggagggctggccagcagcagggtccccagcagagttcgagagaacacaggtcccacggcacatcagcaggttcctgggccaaaaaggcactgatgtcagagaatttggctgcacgctgggttaaacagttaagccagcgtctctactgtgggacttcctgggccctcagtgatagtgtggcttcccaaggcgcgtagaatgtagcgcgtttccgaaccccttgacctttggttgcagtgggtcttgcagagctgatggggacagtctggtgttgggccatctgggacacacaggtctactcatgccaggaaaaataaggacagtgtgtcactactaggggggcgaggctagggggatcccatctgaaaagataaggactcaggacttctgcttgccatcagaaaatgaggagtcaggaagacctgagagtgactggttgaaggaaggagggacagggctggcctgctggtggctggcagtgagggaaggcagaggtgtatcctcccacttgtcccctgagtcaccccacaaagacttactgagtacctcctgggttgaggggaccctcaggaaacaggaagcccagggagctgggagaggagagctgggtgggctctcgagacagccctgcagatgaggaggtccagctacccccaaaggacagacggagccccaagaagctgtgggccctggggcagggtgttaggcctgagtgccggagccctctgtgcagaagggtgaggggcagtgctcagtgcccccagcatcactccagaccaccctccaaacgcccccaccccagcgctgggcagtacccccacactctgccaggaagggagagcctagagagcagggcgtggaggggagaggaactggaacttccaaagtcccatcggggaaaatattgaaagtggaggttagggtgacttaaaatagcttgaggtggactttttttaagcctgtaaaaataaatgtatttttgtacagtgtatgacttcttccttgccaacttgctgggaagaaccgagtgattattgacagaaataacagtgcttccgcctgtttatttgaaaataaagcccttctgtggccacc

SEQ ID NO: 28088 - DNA, 3868 bp, Homo sapiens
ggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagatgtggacgagtgcagcatgagcaacgggagctgtgaccagggctgcgtcaacaccaagggcagctacgagtgcgtctgtcccccggggaggcggctccactggaacgggaaggattgcgtggagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggggggagcggccctgcctgggggtggcctggtccgcggagggtgcacctgccctccacagtgggagctgcatgggcctccacaccaccttgggaaccccatggcactgcccttcagggaagccgaccagcccatggagaccgagcccaggcacccttcggacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagca

SEQ ID NO: 28089 - DNA, 3340 bp, Homo sapiens
gagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggggggagcggccctgcctgggggtggcctggtccgcggagggtgcacctgccctccacagtgggagctgcatgggcctccacaccaccttgggaaccccatggcactgcccttcagggaagccgaccagcccatggagaccgagcccaggcacccttcggacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagc

SEQ ID NO: 28090 - DNA, 1119 bp, Homo sapiens
cccagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctcatcaaactgctgcgctccaaagtgtctcggttcctgcggccctacaaataaccggg

SEQ ID NO: 28091 - DNA, 524 bp, Homo sapiens
ccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgcc

SEQ ID NO: 28092 - DNA, 3727 bp, Homo sapiens
gcgcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggaga

SEQ ID NO: 28093 - DNA, 2912 bp, Homo sapiens
gcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaacttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagagggga

SEQ ID NO: 28094 - DNA, 4683 bp, Homo sapiens
ccgcgcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataataatgtacatttattgccagccttcctcgttgcaagcttccaccctgcagcaaatgcactatgctgactctcgcaccttcagctgtgccctctgacactctgctggccattgcctgagggactggggagttcaggtgaaatgtaatttcctcagtggatgagaatcatcaattgtcatgaaaaggcgatttcaccaaccctgagtcggtattgccaagggttctactccccaagtgggcttcccatcacaagggatctgaggtccaggtgggtgtggtgaggcccagcctgtcatgtatgccttccttccccagtctcaaatgtgagagacggactctgctccgtggacatgagcagccccttgaagggtggtctcattctctaacagtaacagcactgccagaaacaccccctgaatgccacacgatcatctcactttgggtcaggccagcagggcctcacgatcatttcttgaacttgaattttcagtgttattgaatctttaaacatttaaatccccaagcaaaaatctcattacagtgaataaaaaggaatccaatcaaacaagccaccacttccctaatggatggactacctacaactatagtgttttgttatttcaataacaattctatgcacagccaattctccataccaaagtactaaaaaaatgtttaacaagcatttttgaagaaaacaaagagaacttcattatggttaaacttgcttttcatctcagtgttgctttttttaacctgttaataacattgattcttaaaaagtcctaatcaaacttctttatttggatgggccctaaatattcattttcagatttctcttcaaaagtttgaacatcatcatt

SEQ ID NO: 28095 - DNA, 1077 bp, Homo sapiens
ccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 28096 - DNA, 937 bp, Homo sapiens
agagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacattatacactaagcctaacttctggttcctaggtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattttgtccaccttttaagttaatgaaataaaatttgaaactgacttttgcagcttttgcttatatactaat

SEQ ID NO: 28097 - DNA, 2841 bp, Homo sapiens
caaacaggcgatgagaaatcgcggacgcggaaccatttcttgggcaggacttccggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattttgtccaccttttaagttaatgaaataaaatttgaaactgacttttgcagcttttgcttatatactaatgctaggagaggagggataattaagaataaaatatgtagtgaaagtttccatagtgtgaggctaaaactagaagaaactgtggtaggtccttttgtgggtgggggacaggggagtctgtaaaaagccagtctgtagatgatattttaatatattattgtaatcgaatcgttcagttgttttttgacatggaaagtcctggattttaagctttaaatttgcttattttgtaggtttaagaacatgattttcatgggagttgtaaaattaactgtgctttagcaccttgaggtacactttccttcaacaaatgaaattggattggtgctccagaatttcagagcggtttctgaaagtagtgattttgagctatcccaattcctgttcttcctgaggcctggtttagctcttccttgaattctgcaagctatctcatattttcagtaaattccattttttttaagtttgtttgtttgtttgtttttgagatggagtttcactcttgttgcctaggctggagtgcaatggcacgatatcggcgtaccacaacctctgcatcccaggttcaagagattctcctgcctcagcctccctaggagctgggattacaggcatgtgccaccacacccggctaattttgtatttttagtagagacagggtttttccatgttggtcaggctggtctcgaactcccgacctcaggtgatctgcccacctcagcctcccaaagtgctgggattacaggcatgagccaccgtgcccggccttctttacatttttattgctcacagtcaaacattcctattgattgtaaaataagcaaacctagagttgtggagatttatatgtatttatttatttgaattgagacagggtcttaaactcccaggctcaagtgatcctcctgcctcaacctcccaaagtgctgggattacaggcatgagctagctggcctgttgactttttttttttaactctaacaatttctgttttatagtgaacataatagtataagacttagtttatatatttgacttacaaataaatcctggggagaggggagtatgtgtaaaacataattcagagcagccttctttgagaaagtgggtgtgtttggctgtgtaacaaaacaataaggggatgtgtttgctgtgtaacaaaacaatgaaggatttaagcaggatatttttgcctcatatgttaaatccaagtgaggttgctgtggtggttggtttagctctcagtgatgccttttttgtatttttccgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagtgaacacagcagtcctccttatccttggggaatacattccaagagtggatccctgaaacagcagatagtactgaaccctatatatactatgtttttgcctatgtatatatacttgatatggtttggctgctacccaacccaaaatctcatcttgaattataatccccaaatccctatgtgttaagggtgggaccaggtggagataattggatcatgggggcaatttcccctgtgctgttcttgagataatgagtgactctcaggagatctgttggttttataagtgcctggcgtttcccctgcttgcagtcactccatcttgc

SEQ ID NO: 28098 - DNA, 660 bp, Homo sapiens
cgggttcctcccgggtttctgccgggtttctccctgcggctcctgggttgttgagactcttgtgaagatggcttgcgctgccgcgcggtccccggccgaccaggacaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttg

SEQ ID NO: 28099 - DNA, 2279 bp, Homo sapiens
gagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagtt

SEQ ID NO: 28100 - DNA, 2187 bp, Homo sapiens
gagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagtt

SEQ ID NO: 28101 - DNA, 572 bp, Homo sapiens
agtcacacctctatctctcatctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgt

SEQ ID NO: 28102 - DNA, 558 bp, Homo sapiens
atctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaagagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatg

SEQ ID NO: 28103 - DNA, 2327 bp, Homo sapiens
gagatccaagacgcaactcccaccgccaggcggtcgcctcagaagggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 28104 - DNA, 2398 bp, Homo sapiens
gcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggtgagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatg

SEQ ID NO: 28105 - DNA, 2515 bp, Homo sapiens
ccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatg

SEQ ID NO: 28106 - DNA, 1941 bp, Homo sapiens
ggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtac

SEQ ID NO: 28107 - DNA, 1236 bp, Homo sapiens
atccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgg

SEQ ID NO: 28108 - DNA, 2386 bp, Homo sapiens
gcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgg

SEQ ID NO: 28109 - DNA, 1974 bp, Homo sapiens
ccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgg

SEQ ID NO: 28110 - DNA, 1706 bp, Homo sapiens
ccttcattgctttttaggatgtttgtaaaattcccagtgggaacttagagctttgtgggagcagtggggaggttttttggtttcagcaccttgatgcagaggcttagttaaagggagcagaggtgatacgtggcagtcaagaggttttaaacttgaactgtaccctaccgacaggaaaagaggcaaatcctgtgtagctggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgg

SEQ ID NO: 28111 - DNA, 3983 bp, Homo sapiens
gctaagtaacttgtttattgtcagacatctagtgagtcgcagagccagggaactgaccacgggcattttcaccccattacccttccagcttattgccgactgctcccgaagggagcgaaaaggacaggcaaagggtttcaccaaaccctttgtaatgggagattcttgccttcttacctttcctcacgtttgcttctctgccagaatgtcttcccgcactttccccagaacccaagttctcctaatcatctttcaagatccctttccctcaaccacagatgagccgtgcctatttctccttcaaatgactccctatggcttctagttggtagtcttttatttaccacctcatagtccttttatttatatcccataaatgatcgtccggccccgcaccgtgggaccaggacgctgcctcgaccatggcggtctcctggaaacaggctgctttgagccgaaactggtgaccgtttcccaaccccgtccaggagtccgacgcctcttttctccaggccaacttcaagtgaggtgtatcaactctatccgcacaaatttcttgccacgagagcagaagattatgatctctgatgctgccttagggctgaagacactcccaactcggcgacgcttagcaatcatcgacttcctcctcctcttggctgcctcggagatcctgttccggggcagaggtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaa

SEQ ID NO: 28112 - DNA, 3688 bp, Homo sapiens
gggcagaggtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatgg

SEQ ID NO: 28113 - DNA, 2473 bp, Homo sapiens
gcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatat

SEQ ID NO: 28114 - DNA, 3050 bp, Homo sapiens
gatggggagggcacccggcgttctgagcggaagtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaa

SEQ ID NO: 28115 - DNA, 1116 bp, Homo sapiens
tttccggtctttcggatgctgacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattga

SEQ ID NO: 28116 - DNA, 895 bp, Homo sapiens
cggtaagtccggaggcttagggcgtccgaacgggagaggcgagagcctcgtgtccgcgcatcaccccgtggctgggggttagctaggggagggcgggaagggcagaggacgcggtggctggaggacgtgtaaccttgcaagaggcgggaggcggggggcagagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctg

SEQ ID NO: 28117 - DNA, 351 bp, Homo sapiens
gtttgggatgccaacgggtgaagatggtaggagagtctggagaacgggtctgctctggtggcttatggactactctgtggaaggggctgctgttctgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccc

SEQ ID NO: 28118 - DNA, 555 bp, Homo sapiens
ggcagaggacgcggtggctggaggacgtgtaaccttgcaagaggcgggaggcggggggcagaggtgattgacccccgcccccccgcccgtgggaccaagaaagggatgtgacagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcatttt

SEQ ID NO: 28119 - DNA, 1671 bp, Homo sapiens
gccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 28120 - DNA, 526 bp, Homo sapiens
gcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 28121 - DNA, 643 bp, Homo sapiens
tcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 28122 - DNA, 745 bp, Homo sapiens
ccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 28123 - DNA, 427 bp, Homo sapiens
ccgtgggctctggctgccggagtgctgcagtgtcggcactggtggtcagggtggcccctccgtgtccactctgcccacactctgctcaacacccaacccaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacagg

SEQ ID NO: 28124 - DNA, 4034 bp, Homo sapiens
tttctcttctctgtgtcgtcagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaa

SEQ ID NO: 28125 - DNA, 3037 bp, Homo sapiens
aaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggtgaggggttgcctccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgccc

SEQ ID NO: 28126 - DNA, 2703 bp, Homo sapiens
agacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatccctgactggaagggaagttcaggctctgagacacaccccaacatgcctgcacctgcagcgcgcacacgcacgcacacacatttacactagaggccagggatagaggatattgggtctcagccctaggggaatgggaagcagctcaagggaccctgggtgggagcataggaggggtctggacatgtggttactagtacaggttttgccctgatt

SEQ ID NO: 28127 - DNA, 2886 bp, Homo sapiens
gcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgact

SEQ ID NO: 28128 - DNA, 2879 bp, Homo sapiens
acactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatgg

SEQ ID NO: 28129 - DNA, 2037 bp, Homo sapiens
atgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggccctgattcctcca

SEQ ID NO: 28130 - DNA, 2776 bp, Homo sapiens
actgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcct

SEQ ID NO: 28131 - DNA, 3119 bp, Homo sapiens
cctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgat

SEQ ID NO: 28132 - DNA, 670 bp, Homo sapiens
agagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttca

SEQ ID NO: 28133 - DNA, 553 bp, Homo sapiens
acagacctatggggcctggaagtgcccgctgagaaagggagaagacagcagaggggttgccgagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatcca

SEQ ID NO: 28134 - DNA, 603 bp, Homo sapiens
ggttctctatcgctcatacccagcactaccaagtcaggggccttcctgcagtaccattcagctgcacccagatgccccaagagcaatgagcccacacgcagagctggaggacctgaaaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaaggggg

SEQ ID NO: 28135 - DNA, 565 bp, Homo sapiens
cctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaagg

SEQ ID NO: 28136 - DNA, 644 bp, Homo sapiens
aaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgagagaaaggcctattggaggaacctgagcaggaggggtaaggattctgccttgaggagaaaagagctggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatactt

SEQ ID NO: 28137 - DNA, 661 bp, Homo sapiens
acattcacgcattgggcaactcagagaagctgttttaactttcgatcctgtggtcccacaatcagaggactcgggcagataggggttgagataagcgagtttaggccaccaagcgggcggacgaggatcccagaccttgcgcttcccttctgagtttgggaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaag

SEQ ID NO: 28138 - DNA, 2924 bp, Homo sapiens
gtatgcaggagtgggggctggggagagggtgcccccaggggtccaagggggacgcggaatctcactcaccgtcgatagccgccgcgaccagagctgagagcaggggcagcagcaggagcaacggcggggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaa

SEQ ID NO: 28139 - DNA, 644 bp, Homo sapiens
cttccccttcaaggggctgaagacaaaaggtgcccctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggagggga

SEQ ID NO: 28140 - DNA, 729 bp, Homo sapiens
ggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttag

SEQ ID NO: 28141 - DNA, 2972 bp, Homo sapiens
agctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagtaatcta

SEQ ID NO: 28142 - DNA, 740 bp, Homo sapiens
ggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggataaggaaaagagaggatgtgtcttacaaaaagttttaaaataccaaaatggggttttaagaagctttttgagagagatgaggatttgcccaccctttaaacagacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggct

SEQ ID NO: 28143 - DNA, 1984 bp, Homo sapiens
ttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttctt

SEQ ID NO: 28144 - DNA, 5701 bp, Homo sapiens
gaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcaggcaagagccgggcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgagatacttatgacaaactcgctctgtcacccaggctggagtgcagtagcatgatcgacagagtgagtttgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgta

SEQ ID NO: 28145 - DNA, 3628 bp, Homo sapiens
ggcagggtgactggggtcccatgacagctgctgtgaccccagcaccttcctcaggatgtgggggcctggcagagggctgggcccacagttggggctacttcctgtgctgaaggaagtcctcttgccattcctgctgccctgccgctgcctccctgggaacccatgtgtccttgtggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatg

SEQ ID NO: 28146 - DNA, 3082 bp, Homo sapiens
cagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtgg

SEQ ID NO: 28147 - DNA, 379 bp, Homo sapiens
gggcggcggcggctgggcgggagccccagaggtactggcgggagcaggggacgggaggcactactgtcgggcccgacaggggagaggtggcctagccgtgggcccgggtgatgtgtatgggagtggggtcctcgccacgttcgccgccagcaccctcccaacttccctccgggctccagctcagtcccgagtcaatatgtccagccccctgtctctgaccagccgttcctactctctctgtgtgacggcttagcctggccagccagccgggcaggaactgctgccacaacctcaggctgggcaccaaacacccgtgcccgccaatgcggcccagcccccggagagtcaggcccacagagcatgcccatgtgggccggcg

SEQ ID NO: 28148 - DNA, 562 bp, Homo sapiens
agcgggaccccagcgcgggcggcggcggctgggcgggagccccagagtctcactctgtcccgcaggctggagttcagtggcgcgatctcggctcactgcaacctctgcctcccaggtttaagcgattctcctgcctcagcctcctgagtggctgggactacagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaacc

SEQ ID NO: 28149 - DNA, 3521 bp, Homo sapiens
aggcggagccggcgccgggagcggtagcgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaa

SEQ ID NO: 28150 - DNA, 6555 bp, Homo sapiens
cttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataag

SEQ ID NO: 28151 - DNA, 2937 bp, Homo sapiens
acttactgtcataggtcttattaaataggtatctatgtagtcagagcatgtttcatagaaatggagtgttcattaaactgaaacttcatacattgcctctgggcttttggggataggagtatgatacctcccaacttgaaattcccacagataggtgaggtcatagtcatcgggtgatacttaatgagcccatgtttttctttcattggatgtaaactatgctcgatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaac

SEQ ID NO: 28152 - DNA, 6690 bp, Homo sapiens
actaggggtgggcattgtgtgtggctcccctgtggtagagaaggacatcggatgaacatgtgatctgtgtatccagctccaacccaaaaggtgaaggaaatactcatgaccagccagatgtcttaaggaatgcttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataagaaa

SEQ ID NO: 28153 - DNA, 1910 bp, Homo sapiens
acagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttg

SEQ ID NO: 28154 - DNA, 4006 bp, Homo sapiens
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaacccgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaattgcaa

SEQ ID NO: 28155 - DNA, 1243 bp, Homo sapiens
acagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtgacagtcatcatcagacttcggacttattctaa

SEQ ID NO: 28156 - DNA, 883 bp, Homo sapiens
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgt

SEQ ID NO: 28157 - DNA, 1021 bp, Homo sapiens
gaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagagcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagacc

SEQ ID NO: 28158 - DNA, 2642 bp, Homo sapiens
agaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggtgagacacttctactgaggtgtatggtggtcggctcctgcactgatggtatgataaaatgggtgaaggtgagcactcaggaccaacaggaaatttataactttaaacgtggctccttccctggggtaatgcccatgatccaacggacatcagaaccactgaattgtgattattccatctatatccacaatgtcaccagggagcacactggaacctaccactgtgtgaggtttgatggtttgagtgaacactcagaaatgaaatcggatgaaggcacctcagtgcttgtgaagggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctc

SEQ ID NO: 28159 - DNA, 852 bp, Homo sapiens
ttagcacagtgactacaggaatcacagcccagacacaaaagcaggaaaccctttgaccgggctccttcctattgcaccaacagccttgtgttgctgcaatgaaaacacttccccaagcagctgtggccaagagacgcagaaactgccttgtccacgggccccgcctcagactccaacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagagcaaaatctacctcttccaaagaggcagaattcaccagtgaacctgcaactgagatgtctccaacaggtgagcgtacccacctcagtggagtcaatgagtcccccacaggcaagggggccatga

SEQ ID NO: 28160 - DNA, 1124 bp, Homo sapiens
gtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagagcaaaatctacctcttccaaagaggcagaattcaccagtgaacctgcaactgagatgtctccaacaggtgagcgtacccacctcagtggagtcaatgagtcccccacaggcaagggggccatgaatggcttggtcatgggaagggagcagtcccagactcctggggctaacctgccaccaagaatgctcccaggacttcatctcaactgcagaactaggaccccagagaaccatgttataacagctcagctataacgaactttctcatagccagggccatgtaactgtttagtgggaaatgttgtttgagaggtggtgagctccctgtgattctgagtgtagggacacactgtgaggctatgcacagcgacactggagaacatggctttgtagctaagcctcctggatggagccccttcctagtgtaatgggcaggttctcgccccttgagtctggtatctgactctatgaactagcggggaggggacaagaatcagagaccctacttcatggggttgtgtgtgcactcaaggagatcacacatgccaggtgtccagaactgtgcctagcacatctcatgttaacattcaaggactctca

SEQ ID NO: 28161 - DNA, 2539 bp, Homo sapiens
ttagcacagtgactacaggaatcacagcccagacacaaaagcaggaaaccctttgaccgggctccttcctattgcaccaacagccttgtgttgctgcaatgaaaacacttccccaagcagctgtggccaagagacgcagaaactgccttgtccacgggccccgcctcagactccaacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctc

SEQ ID NO: 28162 - DNA, 1480 bp, Homo sapiens
aacactcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggtgagacacttctactgaggtgtatggtggtcggctcctgcactgatggtatgataaaatgggtgaagggagcacactggaacctaccactgtgtgaggtttgatggtttgagtgaacactcagaaatgaaatcggatgaaggcacctcagtgcttgtgaagggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggagacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggtgagcgtacccacctcagtggagtcaatgagtcccccacaggcaagggggccatgaatggcttggtcatgggaagggagcagtcccagactcctggggctaacctgccaccaagaatgctcccaggacttcatctcaactgcagaactaggaccccagagaaccatgttataacagctcagctataacgaactttctcatagccagggccatgtaactgtttagtgggaaatgttgtttgagaggtggtgagctccctgtgattctgagtgtagggacacactgtgaggctatgcacagcgacactggagaacatggctttgtagctaagcctcctggatggagccccttcctagtgtaatgggcaggttctcgccccttgagtctggtatctgactctatgaactagcggggaggggacaagaatcagagaccctacttcatggggttgtgtgtgcactcaaggagatcacacatgccaggtgtccagaactgtgcctagcacatctcatgttaacattcaaggactctcagtatctggtgggagcttgtgatagatgtggtcagatttgccttcctgatgctcggccctgctcctgccattcatgggggccagacggcctgggtcccgtgacttctttaacacatgtggccctgagaaaatcatttccccactctgggtctgtctccttatctat

SEQ ID NO: 28163 - DNA, 831 bp, Homo sapiens
atgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgaggcccggcatcatcccttactgcgctgctcctcatagctgtcctcctgggccccatctacgtcccctggaagcagaagacctga

SEQ ID NO: 28164 - DNA, 1716 bp, Homo sapiens
agagcagggcctgacatctccccagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggtggggaaccaggtaaacgtcacctgccaggtgaggaagttctacccccagagcctacagctgacctggtcggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctagaggtcacagtccaccagaaggaccagagctcagatgctacccctggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 28165 - DNA, 1042 bp, Homo sapiens
agaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 28166 - DNA, 1732 bp, Homo sapiens
aagcatgatgggttttactagaacgtttcagtgtcactaagtcacagaagaggaggacaagaagaggaattatggcagggaccagctttatcacagtggtgtacctggtttggcagggtgctcacaacttgtttgtgggatgtggaggtatcagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggtggggaaccaggtaaacgtcacctgccaggtgaggaagttctacccccagagcctacagctgacctggtcggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctagaggtcacagtccaccagaaggaccagagctcagatgctacccctggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 28167 - DNA, 1383 bp, Homo sapiens
agagcagggcctgacatctccccagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgaggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 28168 - DNA, 1895 bp, Homo sapiens
ctggaattgtgggagttgtgtctgccactcggctgccggaggccgaaggccagctattacttctctactgaggccaactgtgagccctggtgtgtttcattggcaggagaagaggctaattaagtgaaactgaaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccatcctctttctgctgtgtgtctgtgtagactgggcacagccctgtggccggggggtcaggtgagtggttgggtgatgggctctgctgacgtgcagggctcagcccagggcatccaggaacaggctccagggcaggaacctgggcccaggagttgcaagtctctgcttcttaccaagcagcagctctgtaccttgggaagtcgcttaattgctctgagcttgtttcctcatctgtca

SEQ ID NO: 28169 - DNA, 1923 bp, Homo sapiens
gcggcgtgacagctgccagctcaccggctcagacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccatcctctttctgctgtgtgtctgtgtagactgggcacagccctgtggccggggggtcaggtgagtggttgggtgatgggctctgctgacgtgcagggctcagcccagggcatccaggaacaggctccagggcaggaacctgggcccaggagttgcaagtctctgcttcttaccaagcagcagctctgtaccttgggaagtcgcttaattgctctgagcttgtttcctcatctgtcaggagtgccattaaaggagaaaaatcacgtagaaa

SEQ ID NO: 28170 - DNA, 442 bp, Homo sapiens
ctctctctctctctctctcactctgtgtacgtgtgtgtgtatactgaggaaaggccatgtgaagacatggcaagagggcagccatctgcaagctaagatgagagtcttcagctggaaccttgatcttggacttctggccttcagaattgtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatct

SEQ ID NO: 28171 - DNA, 675 bp, Homo sapiens
gggagttgtgtctgccactcggctgccggaggccgaagggcccaatccccacccccagtcttgtctgaattgtgtggaagacatgaggcactgagagaggtgggggccgagtggcctcctcccacctgctccccaaacatctgctctgggctgcagtaagctggcaatacagattggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgcccc

SEQ ID NO: 28172 - DNA, 572 bp, Homo sapiens
cacacccagggatggccagtcacctatccagagcctggtgtggtgctgtgaactcaatccctgtctttcagtgtgattggtgccccagggagccaggttgctgggggaagctctcgtggcactcagccgttccattttgtcggcaaaaaaagagggggggagctggcagaaagctaaggcttttgctgctgggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacacca

SEQ ID NO: 28173 - DNA, 1431 bp, Homo sapiens
agacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggcc

SEQ ID NO: 28174 - DNA, 5050 bp, Homo sapiens
gttaaacagctgcttttaatttggtccccccaatctcaggcgtttggggggctagtccgccggccgctcggtctggccggcccgacgtggtgtgggccctgcgggccctgggaccgagctgaggggaggctcggagttccgcggccgaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaag

SEQ ID NO: 28175 - DNA, 6737 bp, Homo sapiens
gggatttcccgggtaacagagaagcggccgcggcggtagaggcggcggagacggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaa

SEQ ID NO: 28176 - DNA, 6679 bp, Homo sapiens
ccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggtgagagcacgctgggccgggggccgggcgggagcctggtggcgggtaacgccggactcgagggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggct

SEQ ID NO: 28177 - DNA, 5033 bp, Homo sapiens
ctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctatctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatc

SEQ ID NO: 28178 - DNA, 5129 bp, Homo sapiens
ctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggagcttgaccattggacacttctccagggttcgtggacagacgattactgcatgtccaagttcaagaatacctgctggattccaggatatagtgcaggggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctatctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatc

SEQ ID NO: 28179 - DNA, 4140 bp, Homo sapiens
aatagacgggaggctcgttacggcggcggaagcagcggcgctggagtgaggggtggggggcagagtgctagctccccggcggtggctgcgggtccggagcctggggacgtcggccccacagacggagagcgcgcgggagcgagctcaaggcggcgcggcggccactgggcgcagcacccaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttg

SEQ ID NO: 28180 - DNA, 4065 bp, Homo sapiens
gaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgtacttg

SEQ ID NO: 28181 - DNA, 4173 bp, Homo sapiens
aagaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgtacttgc

SEQ ID NO: 28182 - DNA, 849 bp, Homo sapiens
caggggcaggttcgggggaagaggactgcgagcacagcggcggccgggtggcgggggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctg

SEQ ID NO: 28183 - DNA, 2071 bp, Homo sapiens
atgcagcagatccgcccgcccttcatccgcgggcctccgcaccatgcctccaaccccaacagccccctgtccaaccccatgcttcccggcatcgggcccccgcccggtggccccagaaacctgggccccacttccagccccatgcaccggcccatgctatcgccccacatccaccccccgagcacccccaccatgcccgggaaccccccaggcctgctgcccccgccgcctccgggcgccccgctgccgagtcttcccttcccgccagtgagcatgatgccaaatggcccgatgccggtgccccagatgatgaatttcgggctgccgtcgcttgccccgctggtgccgcccccgaccctgctcgtgccgtaccccgtgatcgtgcccctaccggtgcccatccccatccccatccctatccctcacgtcagcgactccaagccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagggatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgataattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtac

SEQ ID NO: 28184 - DNA, 5231 bp, Homo sapiens
agccacgcccgctcgagagccggggggctgtcctcgccccccccacctttcccctccctccgaccccctcccggccgcgctccctcccctcctcccgcgccggcccccggcccgcccccggctcggctcgcgggaggcgctgggcgccggggctggcgcgctctcccgggctcacacacagccgcgcacgcacgcccggggccgctctccgcgccggcccttgctccccgcgcccatgcggacggaccgagcgacggaagatggctgacgactccacggggccccgaggatgcggcccggcggcggcggcggcgggagcggcagcggcagcgagggcggcaggggcagcggcagcagcggcggcgttggctgcggcggcggcggcggcggcagcaggagccggagcgacggcggcggcatccccgagactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttgtatgtgactggtgtaagcacataagacacacaaaagaatacctggattttggggacggggaaagaaggcttcagttctgcagtgcaaaatgtctcaatcaatacaaaatggacattttctacaaagagacccaggccaatcttccagctgggctgtgcagcacattacaccctcccatggaaaataaagcagaaggcaccggggtgcagctgctcactccagactcttggaatatcccgctaacagatgctcggaggaaggccccctccccggtggctacagctggccaaagccagggccctggcccgtcggcgtccaccaccgtctctccatctgacactgccaactgctctgtcactaaaatccccacgccagtgcccaagtccatccccatcagcgagactccaaatatccctcctgtctccgtccagccacctgctagcatcgggcctccccttggcgtcccgcctcggagccctcccatggtgatgaccaaccgcggcccggtgccgctgcccatcttcatggagcagcagatcatgcagcagatccgcccgcccttcatccgcgggcctccgcaccatgcctccaaccccaacagccccctgtccaaccccatgcttcccggcatcgggcccccgcccggtggccccagaaacctgggccccacttccagccccatgcaccggcccatgctatcgccccacatccaccccccgagcacccccaccatgcccgggaaccccccaggcctgctgcccccgccgcctccgggcgccccgctgccgagtcttcccttcccgccagtgagcatgatgccaaatggcccgatgccggtgccccagatgatgaatttcgggctgccgtcgcttgccccgctggtgccgcccccgaccctgctcgtgccgtaccccgtgatcgtgcccctaccggtgcccatccccatccccatccctatccctcacgtcagcgactccaagccccccaacgggttctccagcaacggggagaacttcattccgaacgcccctggcgactccgcggcggcgggcggcaagccaagcggacactccctgtccccccgggactccaagcagggctcgtccaagtccgcggactcgccccccggctgctcgggccaggccctgagcctggcgcccacgcccgccgagcatggccggagcgaggtggtggacctgacgcggcgcgccggcagccccccgggccccccgggcgcgggcggccagctcggcttcccaggcgtgctgcagggcccgcaggacggcgtcatcgacctgaccgtgggccaccgagcccggctgcacaacgtgatccaccgcgcgctgcacgcgcacgtcaaggcggagcgcgagccgagcgccgcggagcgcaggacctgcggcggctgcagggacggccactgcagcccgcccgccgccggcgacccaggcccgggcgccccggcgggccccgaggcggccgcggcctgcaacgtcatcgtgaacggcacgcgcggcgccgccgccgagggcgctaagagcgcggagccgcctcccgagcagccgccgccgccgccgccgcccgcgccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagggatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgataattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgctt

SEQ ID NO: 28185 - DNA, 1639 bp, Homo sapiens
gttgccgctgcgcacctggctcaggtgagctgccccgcccccgcccggcgcgagccccaggtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 28186 - DNA, 1700 bp, Homo sapiens
ggtgagtggcggtcgccatcagacccgcgaagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacagggcacagggcctggaggggctccaggtgttgaggactcttcccggcaccgggagcccctgcacggcctctgccctggaggtgctcggccctcggtctgcctgggaacttcctgggcctcacaggccatcacagcagggggtgagcaggggcagcccctggcagtgggtctgggccaaggctgtgggtggccacctcaggcgtctcggtctccccaccccaggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatga

SEQ ID NO: 28187 - DNA, 1598 bp, Homo sapiens
ggtgagtggcggtcgccatcagacccgcgaagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 28188 - DNA, 1720 bp, Homo sapiens
aagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctg

SEQ ID NO: 28189 - DNA, 1649 bp, Homo sapiens
agtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcagtacaggcctgtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacagggcacagggcctggaggggctccaggtgttgaggactcttcccggcaccgggagcccctgcacggcctctgccctggaggtgctcggccctcggtctgcctgggaacttcctgggcctcacaggccatcacagcagggggtgagcaggggcagcccctggcagtgggtctgggccaaggctgtgggtggccacctcaggcgtctcggtctccccaccccaggtgtccgggggcctgtctttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatca

SEQ ID NO: 28190 - DNA, 1533 bp, Homo sapiens
ccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaa

SEQ ID NO: 28191 - DNA, 1578 bp, Homo sapiens
atgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaacc

SEQ ID NO: 28192 - DNA, 2077 bp, Homo sapiens
agccacgttcggttgagctccaagtagaccagcggcggcggcggcggcggcggcggcagcggtgctggaggcgcagagggcggcgcaggcggagccgggcgggcgcgcgagcgagcggagagcgggcggccgtgcgggcggcggcggcggcacccccaggccgagccggcgcggaaggagttccagggcgatggggccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagcc

SEQ ID NO: 28193 - DNA, 1666 bp, Homo sapiens
gggggctttgttcggccgggagcgctctcccttccctgtcctcggcttcgtcaccggttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagcc

SEQ ID NO: 28194 - DNA, 560 bp, Homo sapiens
cctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtga

SEQ ID NO: 28195 - DNA, 1711 bp, Homo sapiens
gcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagggcccccccggctcccagccgtccccccacaaccccaacgcccccatgatggggcctcacggtcagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggt

SEQ ID NO: 28196 - DNA, 1645 bp, Homo sapiens
gcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggt

SEQ ID NO: 28197 - DNA, 3999 bp, Homo sapiens
cccgaattttcaaagaacatattttccgttcacccccgctggtcttttactgccatcaatacactgttcttggtgcaaatacttcagcctctttattcaaagtatgttttatgtttttgccaaatatgatctctaattgaaagtttatttttggttttggatgaatctgcggagcttaagttgtgagaagaaagggggaacaagacacaatgaaagaaaagtccaaaaatgctgcgcggactaggagggagaaggaaaacagtgaattttatgaactggctaaattactgcctttgccctcggctatcacctcgcagctggacaaagcatccataatcagactcacgaccagctatctcaaaatgagagtggtgttcccagaagggctcggcgaggcgtggggccactcaagtcggaccagccccctggacaacgttggccgagaactgggctcccatctgctccagaccctggatggcttcatcttcgtggtagccccagatgggaagatcatgtacatctcagagacagcctcagtccacttgggtctttctcaggtagagctgaccggaaacagcatttatgaatacattcacccggcagaccacgacgagatgacggcggtgctcaccgcccatcaaccctaccactctcacttcgtgcaggagtatgagatcgagcgctccttcttcctgaggatgaagtgcgtcttggccaagcgtaacgccggcctcacctgtggcggctacaaggtcatccactgcagcggctacttgaagatccgccagtacagcctggacatgtcccccttcgacggctgctaccaaaacgtgggcctggtggccgtgggccactcgctgcctcccagcgccgtcacggagatcaagctacacagcaatatgtttatgttccgcgccagcctggacatgaagctcatctttctggactccagggtggcggagctgacggggtacgaacctcaggacctgattgagaagactctgtaccaccatgtgcacggctgcgacaccttccacctgcgctgcgcgcaccatttgctgctggtgaagggacaggtgaccaccaagtactacaggttcctggcgaaacacggcggctgggtatgggtgcagagctacgcgaccatcgtgcacaacagtcgctcctccaggccacactgtatcgtcagcgtcaactatgtcctcacagacacagaatacaaagggctgcagctctccctggatcagatctcagcctccaaaccagccttctcctataccagcagctccacccccaccatgactgacaacagaaagggggccaaatcccggctctccagctcaaagtcaaaatccaggacttccccataccctcagtattcgggatttcacacagaaagatcggaatctgatcatgacagccagtggggcggaagtcccttgaccgacacggcctctccgcagcttctggaccccgccgataggcctggctcccagcacgacgcatcgtgcgcctacagacagttttcggaccgcagctctctctgctatggctttgcgcttgaccactcgaggctggtggaagagaggcatttccatacccaggcctgtgaaggaggccgatgtgaggcaggcaggtacttcctgggaacgccgcaggccgggagggagccctggtggggctctcgcgcagccttgcccctgacaaaggcctccccagaaagcagagaagcctatgaaaacagcatgcctcacatcgcttcagtccacaggatccatgggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgacttgaaaaatattcatgtagatcaagtgtgcatatatactacatgagaggactgatgaatgacaacattgcattgtgactatccagtgatcctcaaacacacaaactattacttacaaactgcggtatacattttacatatggaaatataggctatgtaatgtaaatacatcaaaaatgggtaattttctttgactctgtcacactaaacttcttaacgaaatttccattcccaaaataactgagaaagagagagatacatcttataaactgacttctttgtggtttcaaatcagccagctcatttggttcaggcataaattagagaaatggttctggatatggtgcaaaaatgagttttcacctggtatccattataaacaatcaggaagaggtaatttttcaccttgcttttcagttagacaaggaccaggattgcactgacatggcgctgagggtttttctaagtaagaacactgagatattgggacacacatcaaaaacctggagtgctcaattggaagtagttctatgaatatggaaaggccagaggcagagtgaaataaaatgctatctcaaagtttaacacaatttaagggctcagcataagtaaacaacatatttggggtttgcttgtaaaaccaactaaataaaaaattcaaaccaattcacccagaaaaaagaccaataggtgcaaaaataaaaggaaaaccagtgaagtgccacatgacagcagtgttaagtgtttgaaaacgtttcaaagcacatatgtgccaatgtgacaacatgtggaaagcctcaggagagagtctaagataaaagcttaggctgatagacaagtagttaagagctaagagcagtactctgaaggaataggcaaaatgtttattttccttattgtttgtaaacaacaaacttggtcttacatctgtgtggtatagtagaaaggccagctgactagatctctggattctaattttggccctacctgtaacttaattttgtgaccacagttgtaccattcaccgtgcctgggctctagtttcctggtttgtaaggcagccccagcgttcatgttctgtgatagagcagaactgaacttattacctaattaactctctgctatgagttgtcaagactgatcattctgttttttctgtacacagaagtttagatgctttgtgacttaagcaggtgtgtgggctcctttaggcaggttacagttaactttctagatt

SEQ ID NO: 28198 - DNA, 8430 bp, Homo sapiens
aaacccttaagctataaagaagttacggggggcagttttcggcttccaattaggaataatagtgaactggcttcgtagcaactacggaggaccaggattctaaaatcacctcactcgtcccaaagcttgcatcctcctctttctgccacgcacccctcctccaattcatgatccagaaaagggagccgggaatgctctgctcctctctgccggtgggaagcggagaggccggcggtgtcgctgggttggacggtaggcatgagaacagttaagagatgggcgcccccgaaacctctgccgcttgtggggactgaagggccttgaaagagttgtctggggttcctgctcttcccaaaggggctcggagataccttaaatgccgcgagactgaagagcaaacgtcagggattattatgtcgattttccgaggaccagggttcgcagctggcagtagaagaaaaggctggctcctcaggggtcccactggcatttgataccctgaacgaccctcaggattgcccaaattcggtggatcgcccaaattcggtggatcagcaactttcctatactgcatcccgaattttcaaagaacatattttccgttcacccccgctggtcttttactgccatcaatacactgttcttggtgcaaatacttcagcctctttattcaaagtatgttttatgtttttgccaaatatgatctctaattgaaagtttatttttggttttggatgaatctgcggagcttaagttgtgagaagaaagggggaacaagacacaatgaaagaaaagtccaaaaatgctgcgcggactaggagggagaaggaaaacagtgaattttatgaactggctaaattactgcctttgccctcggctatcacctcgcagctggacaaagcatccataatcagactcacgaccagctatctcaaaatgagagtggtgttcccagaagggctcggcgaggcgtggggccactcaagtcggaccagccccctggacaacgttggccgagaactgggctcccatctgctccagaccctggatggcttcatcttcgtggtagccccagatgggaagatcatgtacatctcagagacagcctcagtccacttgggtctttctcaggtagagctgaccggaaacagcatttatgaatacattcacccggcagaccacgacgagatgacggcggtgctcaccgcccatcaaccctaccactctcacttcgtgcaggagtatgagatcgagcgctccttcttcctgaggatgaagtgcgtcttggccaagcgtaacgccggcctcacctgtggcggctacaaggtcatccactgcagcggctacttgaagatccgccagtacagcctggacatgtcccccttcgacggctgctaccaaaacgtgggcctggtggccgtgggccactcgctgcctcccagcgccgtcacggagatcaagctacacagcaatatgtttatgttccgcgccagcctggacatgaagctcatctttctggactccagggtggcggagctgacggggtacgaacctcaggacctgattgagaagactctgtaccaccatgtgcacggctgcgacaccttccacctgcgctgcgcgcaccatttgctgctggtgaagggacaggtgaccaccaagtactacaggttcctggcgaaacacggcggctgggtatgggtgcagagctacgcgaccatcgtgcacaacagtcgctcctccaggccacactgtatcgtcagcgtcaactatgtcctcacagacacagaatacaaagggctgcagctctccctggatcagatctcagcctccaaaccagccttctcctataccagcagctccacccccaccatgactgacaacagaaagggggccaaatcccggctctccagctcaaagtcaaaatccaggacttccccataccctcagtattcgggatttcacacagaaagatcggaatctgatcatgacagccagtggggcggaagtcccttgaccgacacggcctctccgcagcttctggaccccgccgataggcctggctcccagcacgacgcatcgtgcgcctacagacagttttcggaccgcagctctctctgctatggctttgcgcttgaccactcgaggctggtggaagagaggcatttccatacccaggcctgtgaaggaggccgatgtgaggcaggcaggtacttcctgggaacgccgcaggccgggagggagccctggtggggctctcgcgcagccttgcccctgacaaaggcctccccagaaagcagagaagcctatgaaaacagcatgcctcacatcgcttcagtccacaggatccatgggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgacttgaaaaatattcatgtagatcaagtgtgcatatatactacatgagaggactgatgaatgacaacattgcattgtgactatccagtgatcctcaaacacacaaactattacttacaaactgcggtatacattttacatatggaaatataggctatgtaatgtaaatacatcaaaaatgggtaattttctttgactctgtcacactaaacttcttaacgaaatttccattcccaaaataactgagaaagagagagatacatcttataaactgacttctttgtggtttcaaatcagccagctcatttggttcaggcataaattagagaaatggttctggatatggtgcaaaaatgagttttcacctggtatccattataaacaatcaggaagaggtaatttttcaccttgcttttcagttagacaaggaccaggattgcactgacatggcgctgagggtttttctaagtaagaacactgagatattgggacacacatcaaaaacctggagtgctcaattggaagtagttctatgaatatggaaaggccagaggcagagtgaaataaaatgctatctcaaagtttaacacaatttaagggctcagcataagtaaacaacatatttggggtttgcttgtaaaaccaactaaataaaaaattcaaaccaattcacccagaaaaaagaccaataggtgcaaaaataaaaggaaaaccagtgaagtgccacatgacagcagtgttaagtgtttgaaaacgtttcaaagcacatatgtgccaatgtgacaacatgtggaaagcctcaggagagagtctaagataaaagcttaggctgatagacaagtagttaagagctaagagcagtactctgaaggaataggcaaaatgtttattttccttattgtttgtaaacaacaaacttggtcttacatctgtgtggtatagtagaaaggccagctgactagatctctggattctaattttggccctacctgtaacttaattttgtgaccacagttgtaccattcaccgtgcctgggctctagtttcctggtttgtaaggcagccccagcgttcatgttctgtgatagagcagaactgaacttattacctaattaactctctgctatgagttgtcaagactgatcattctgttttttctgtacacagaagtttagatgctttgtgacttaagcaggtgtgtgggctcctttaggcaggttacagttaactttctagatttagccaaaatgtagttggtagaaatttatgacagagaagaaaaatagcaagatttatttaatgctctattctctagtaattaaagcaaaatgatataagtgattagagagatttcatagataatatttcctaggagtcccgtgcccaaaactcttgccatatttaaggaagggaatgtactggcagaacttgacttacaattttggaaacagaacatgaaattgaatactcagggattagtagtatattttcatcatttaacacagttatttcacagtccataggtaggtgacaatctgaacgataatatgaaagatgagtactgggttgtttgtatatgaaaggagaggctacataaaattaaataatgttaacatttgtgctgtaaatgcaaaaaagtgcaagtaagtgagaaagttagtggttatatatattttcaaaaaattcaaagtgcagttgacccttgaataacatgggtttgaactgtgcagattcacttatgtgtggttttttttccaatcaaatgcagataaaaaacccagtatttggagaaatgtgaaacctgagtatacagagggcgatgttttgtataagtgagcgccacagggccaacaggcaggacttgagtatgtgagaatttgattatatgggggtaatcctggaaccaactccctgtttataccaaggggtgaccatacaataaaaactaagttttgaattatacaaaaaagagtatttagtaattttgagaaaattatttatgagaaatcctggaatacataaaatggagttttgatcaatttgcaacatgaagtaatgtcttaagaatgctaaaggttttgtagaattctgtagattgatagatgtttggaagaaaaaatatttgatgaatatggtgtattttggaaaggtaattttcacagatgggtatttctggtggctatatattctaccaaatgtgccagggacagaagctaaaagaaatggaaacttaagaaccagggaaaatgaactgatattaaagaaaaggctgtcactaaaggaatttcagtggaatttttatatggaagatagttaactggtgagaagaagaaattatgaatttcacagatgagagtaatcagaaggaataatgctctttaaaatgacatgaccaatatttttaagagaatacagaattaactaaattatatattgattcaaaattttggtagattgacccagttttaagtacataaccattttaaaatttactgaatgtcaataattttatagtagcagttttattacattacataaaatgtcatattgactcactatattgtatagcttacattttttgcaatatggcatgattatcacaaaatgacccaaggtaagttaagacatttgatgacaatgtactttcttaatatacatgtgaatgtgttaaaatgtgtttataatctacattattttgttctgtgcagcaacatatttcctcataatgaagatgtcatctgtgtcttttaaaaatagtatataaaataactacgttcccgataatttaatcagttaaacttaatatggctttagttttaattcttgatttccataactttgccaaatgttgagaaacatgaaacttgattgaaatagatacagaagtatgattttcatatcaccttggggatacataaaaatgtgctctatccaattactggtataatatgtatcaattcattagatgatacatagctcatggttttgtagaattctggtttctagtgataataagtatctttattgcccatttcacctgccatacctactttaaaaatttggatgaccaaagaagtgaatgaagtttccccaatctttcttgggaaaattctgtttaaattgttattgggaatatatagatttgatgtgttattttgggatgtgtaatattaatgtcacaatcactacaggtcagatatttaggtgtgcttcggtccacaagtcttttgtcatattgtgctcgcttacctaaactgtaattgcctgataaaagataatatgacagtgctgaggtgacattcaaaatgagacgggatgcaataaatgattgccttcagtatttacacagaaaaaccacttgctctttcttggttatatttcatagggctagattgtttccatcgggcactattcttaattcactctataccgtgttgtcacatgctgcctctgggcagagaatcccacttaaaataagctttaggggatcttctagaaaagggtagtgtgctccaatttttatttctccttcttatgggggatgaggatcaattatagtacaagaccatttggaaaatatgcatatatattttaaaatgaaatacaagatttccgccctcaagatctaaaccaagtaagtttgatggatggcagcacagataaagaaatcttctgaatacacatttgatttttatagctctctctttcaagagtaggatattactaagatattcagtgcaatctatcagtcctagtagtatttagaagtgacagagtgaatgctgatatttggaaaattgagcatttgaccattttggggtcactcacctggcctagtggaatagcttacactttaatacaatcaaacacagtctttctgatataaaatgtttgaatgcccagatttggttccctagttcactcaaatcatagatgttgacatacatcctgttttcataatgattttaaaaagaatgtaaatcctatggtcctccaaataaatgattcaacgtttatgtaaatgtcaagtttttgtgaatagggatttatgtctaagacagaaaaatctactgaactagttcttactgtggaactaattgtggataaaacattcgttatcatctaaattttaaatgaatgacaacagttatggacacatgcaaaaggtatcagacatagaaaatattgttgggggaaatttctgtgtggtgctaatttcttgtaagggttgtacagatagtgcttaactcaaaaagtgagagtgtggtcattgccaaataggggtttgctcagagttccttctctaggactgtatgcagaaagcatacacacacacatacgcacacagaaaaatatgatttttatatcatattcatgaaaatgtgccatatccaattataacacacacacacacacacacacacacacacacacacacacataaataaataaatgatggttcacataagaaatcctaattgctaattttaaaccaaacatttgtagttttgtttattgcaactttgctgcatgggactttgctttcataaatctatatggggttggggttaatttgccctaatttgctgacctgggacacatgtaatcactgttaaacttacacccggtaaccctgatgtgtttacatttcaaaagaaatgaaattggcctggaaaaaaattttggaagtactgtaagtcttttttctttttttttccgaagggaaatatttcaaaaaaggaaacattatgagtagacacttcaaaaaagataaaatattttacatttgttttttgactaatgtgctataaaaaggattatatttgtgagaaaagatactgatcgccaatatttcaaataccgtcttgcaatgtatagtttttagtgacattgtagtataaagctgtaatttgaaattttactttggaatgtaaagtagaaaatattagctatgtcaatgatatcttgcaaagtgttcccatttataattatttatattgtaaatagctttctgaagtaaattcgaagttaatgtgcataaaatgtatttattatgtgaggaattttttggtttaaaatatagttaccaatatgca

SEQ ID NO: 28199 - DNA, 4442 bp, Homo sapiens
ccgcacgtggacagcggaggtgctgcgcctagccacacatcgcgggctccggcgctgcgtctccaggcacagggagccgccaggaagggcaggagagcgcgcccgggccagggcccggccccagccgcctgcgactcgctcccctccgctgggctcccgctccatggctccgcggccaccgccgcccctgtcgccctccggtccggaggggccttgccgcagccggttcgagcactcgacgaaggagtaagcagcgcctccgcctccgcgccggccgcccccaccccccaggaaggccgaggcaggagaggcaggagggaggaaacaggagcgagcaggaacggggctccggttgctgcaggacggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagcggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacggggtacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtcccgctgggggattgaagcggtttcactccgcaaatatcctccactttcaggagggaaaacccaccctaccacagtccgctcttccaagtggacggcagacctgggaggggacgcctgtgtcacgagcccttttagatgcttaggtgaaggcagaagtgatgattgtaagtcccatgaatacacaactccactgtctttaaaagtcattcaagagtctcattatttttgtttttatttaaccctttcttcaatacaaaaagccaacaaaccaagactaagggggtgaccatgcaattccattttgtgtctgtgaacataggtgtgcttcccaaatacattaacaagctcttacttccccctaacccctatgaactcttgataacaccaagagtagcaccttcagaatatattgaataggcattaaatgcaaaaatatatatgtagccagacagtttatgagaatgaccctgtcaagcttcattattacgtggcaaaatccctctggcccacacagatctgtaattcactaggctcgtgtttgctacaaatagtgctaataaagttaaattgcacgtgcaatacggaacactgtcaatggactgcaccttgtgaaggaaaaacatgcttaagggggtgtaatgaaaatgatgtagacattttaagcattttctacacagcgagaaaacttcgtaagaacatgttacgtgtgcaacaggtaaacagaaatcctttcataaagcaccagcagtgtttaaaaaatgagcttccattaatttttactttttatgggttttgcttaaagatctcaacatggaaaaatcctgtcatggctctgaactgcacaatgcattgaaccgccgtccttcaattttcttcacactatcaacactgcagcattttgctgctttatcaaaatggtttattttaggaaactttttccacctttctgaatggaaagaggttttcacaaatgttttaaactcatcgttctaaaatcaagtgcacctacaccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaag

SEQ ID NO: 28200 - DNA, 2414 bp, Homo sapiens
ggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacggggtacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaaggtgggtcaggtctgctcgtggggaaggtgggaggactgcgcacggccgggagccgaagcagccatggcggtgggtggcagatggagacagaaccctcacgctttgggcaaacttgccctctttctgcttctaagtagggcttgctgtgctttcttgctctcaatgcaggtgctcctcgagagtgagaaatggcagtctgcctgcctcggggacactagtgacagtataaagggcaaaggaaaaccgagtatctggccttcacgtaaatcctggccacattcaccaaccaaagggggacagtgattttcaaaaccagctcccatgtgctgagaacaccccagctgcatttcttttgcaagattcctttccactccaaccagaagtgaatatttgagacaaacggcctattggctattttcccatgccagttttggaagtggggaaaactatggtggaaatttgtgggcttggggacagaaatgccactcaccaacccagggcaaagaacacaaaccctccaggcctcagtttcttcacctgtaaaatggggtgaagctgtgatgtgcctactcccaaggacacgacacacagtagggacctgccctgtacatgctagttcaacagaaaggaatggcctttcaccttctcctggtggcaggcaagcagatgtcctctgcggagataccgccagctccccaggacgcagactgactcctgtttgctcgctggaccaaccccaggcagaaggtggaaggtgggaacagaggtttagctgcaggaca

SEQ ID NO: 28201 - DNA, 687 bp, Homo sapiens
ctgtttcctttttcctctggcgagctttgcgttccctgtgcgccggaagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 28202 - DNA, 600 bp, Homo sapiens
agatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggata

SEQ ID NO: 28203 - DNA, 731 bp, Homo sapiens
tagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttgggattctgacacagccagcagcagtacgtgttcatcagcactgaagcagggcacctcctgattcagcagagagaccctcccctccccagccatgttggcggctgccctaggattgctgatgcccattgcaggggctgaatttctcattggcctggttggaaatggagtccctgtggtctgcagttttagaggatgggtca

SEQ ID NO: 28204 - DNA, 630 bp, Homo sapiens
gggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataa

SEQ ID NO: 28205 - DNA, 470 bp, Homo sapiens
gtccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgaaaagcctaaagattagactgtaagaaaagaaaatagaagccatgtttcgaagacctgtattacaggtacttcgtcagtttgtaagacatgagtccgaaacaactaccagtttggttcttgaaagat

SEQ ID NO: 28206 - DNA, 989 bp, Homo sapiens
acctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 28207 - DNA, 676 bp, Homo sapiens
ggtgtccacctctccctatggtgtggctggctagcccgggggtctctacgctgcttggtctttgttaacggagatgaaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 28208 - DNA, 636 bp, Homo sapiens
gtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtag

SEQ ID NO: 28209 - DNA, 8780 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacagaaatcattaaatagcccaaatcatttagaccatagcaataaagtgaccggggttgtcatatatttagcaacatcttttctctttaacatgatgaagcccaaaagtgataacaaaagcatttgcttgaatttgtcacttctcaccaggagtactagaggtaaatttttaataacatactaatgtgaaatggtatctggtttttattcagactttttgtgagcatattcttatagacactagaaataaatacatagaaggagactttgagcacaagggagaagagagttattagcactcctgaggcctctggaatgctgcttttctatccaggtatcttgcttgctaccagcagaattgactggtattggttctcactggccagggagcctctgctctgttcctggaatataaggcttttattcaggagcaaatcattgatagtaactttgctttatctagccattgacttcagcaggctaaaactacattgtgtaactgactgttcaaaaaagaataagtaaattttttttaatctaattcccttatggaaagcaccttgctctatggcactttccagatcttttgggattttgtgcttaattatacatacatacaccaaaatcacaatagaaagatatgaagactttaattttagactctgaaagataactgggtgatcctttgtgttaaaattgtgatacaaacaaccattgataaataccaactatgaatccaaactctagagactttgaaaagcattgtttaattgcaggtaagaggaatcttctctttcctttaggcttatagtctctaaagtgaaaatttggcaggatatagtcatgcagctcataatgacattccaatcaaccacagactgcatatacagcagtggtcctataagattataataccatatttttagcatatcttttctatgcttagatacacaaataccattgtattacagttgcctttggtattcagtacagtaacatgctgtacaggtttgtagcctaggagcaatagtttatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatcataaaatgagcctcagttaatcacacacagtattcaggtgcctaggagtgcacaccggagaacagcctcatgctgtcaagctgcagaaacctttcatgcaaattcagatgaaaaggtctttacctcaagccagggtaacctgaatgaaggtgatagtttgtccagacacctgactttaccaagaagaattttgactttcatattttatgacaatcatataaaaattgacagtcctttgattattaagcttaatcttataatgctagaattttcaaatattttgttgactcttctccattgttaccgatcttgaaattcttttcttcgccttctgagaaggtattatttcttatcacaaagaatgatgaatatgattttatctacccttattttgggggtaatacgagaatatgaattgcatcatgatccccattatttctaacctaaaagtaaaattcgttttttttttcaaggcagagcagtcaattgattataagtatttatttcttttttcttcttggagcccagattaaaaagagttattttagatttaaaaatttcctgaaatagttgaaaaattatttttgaggagaaaattgtatccaagaaacccagaatgtaaggatacttgatttttatatccagataattctttcatgcactgaatggaagacagtatatctgtatattaatttttgtttagattttgaatcatttaacccttatccttttttcttgtaataagactatttaatgtttttctcttgtgttttccatctttatcaatgcattcgtgttggtcttgatgtatactacctgttcctagtgttatttttacacgtcatctcacagtaataatatcagcaattcttgctgcattgaacatattaaatacacatgtaaaatgaaaaagtaagcagtaggtaaaatcttgttactctgctttgcattctgcctaactcactgcatttgaaaatacatgtcaaattctttctgagggtatgtatgattcttaactacgtgtcttacagcaaagttgcccatgggaacaaaggctgtagggtgtcattgatcttgtaatacaacacatatttgatgggtgaatcttattagcactcctttgaaaatgttccagtatggagtcagttgctgataaagaggaagttcacagctaggaatccgaagttaagatttctcaattgccgcctgggcactcatgcctgtaatcccagcacttgggaggccaaggtgggcagatcacctgaggtcgggagttcaagaccagcctggccaacctggtgaaacccccccatctctactaaaaatacaaaaattagccaggtatggtggtggctgcctgtaatcccagctactcaagaggctgaggcgggagaatcacttgaacccaggaggcggaggttgcagtgagccgagattgtgccactgcactccagcctgggtgacagagcaagactccatctcaaaaatagaaaagatttctcaattgccaaaaagattaacaagtaaatcaattctgctcccccagccatgaaaagtgcccaaaacagccctttccctccagaataaaataaaacttccatttctatttttatgattctctaagatatctgaactccattgcatttcatagggttattcagttagcacttctgtggtttaaaagacaacaaatgaaaataagtaagttcagtttggggcatgaagaagtcccacatctgtctatatcttttcttcatcatattgtccctaggaatgtatagcaaagcattcagaactgctcctttggctggggaagttttccaccgtccttaatactatgaagtcttgattacttcttccgtggctttatccttgcctccctcccaatccctgcatcttccaggagaaataaaataccaactgaacactgttaccttctcagcccttaccattttcatctgcatatagtgtatagtactaagagtagttttcccaggagaaataattgcaattttcatttcttgattatcactgctaattcgaaggagtgccacaaatcatagccacttgattttgattttggaatgcattttagtgttttgacactggttttccttttttttaaatttttttttcttttttttttttgagacagtcttgctctgtcacccaggctggagtgcagtggcacaatcttggctcactgccgtctccgcctcccaggttccagagattctcctgcctcagcctccagagtagctggattacaggcatgcgtcacaggctaatttttgtatttttagtagaggcagggtttcaccatgttggccaggctggtctggaactcctgacctcaagtgatctgcccgcctcagcctcccaaagtgctgggattacaggcatgagccactatgcttgatcaggttttcctcttttttttttttttttttgagtcagaatcttgctctgtcacccaggctggagtgcaatggtgtgatctcggctcactgcaaccttcacctcccgggttcatgcaattctcctgcctcagcctcccgagtggctgggactacaggtgctcaccaccatgcccagctaattttttgtatttttagtagagaccgggtttcaccgtgttagccaggatggtctcgatctcctgacctcgtgatccacccgccttggcctcccaaagtgttgggattacaggcatgagccaccgtacctggcccaggttttcctttttttttatgtcttctgtacaatagagttggccctccatatccacaggttccacatccctgattcaatcaactcctgataaaaaatattggaaaaaatttttataacaataaaaaccaataatacaacaataattacaaataatacattgtaacaatgatttccatggcatttataatacattgtattaggtattataagtaaacgagatgatttgaagtatattggaggatgtgcataggttatactatgccgttttatataaaggacttaagcgtctgtggattttggtatctgcagaggtcctggaaccggtctcccttggatacggagggacaactgtagttctctgtctttgaaaacattaatcgatacaagtggccagtgaatgtatagtatgggagggagtaatccagtatgggggacaaggttgccatatatttgccaaaagtagttgaatcttctttctgtttttccctcctggtggaataagtttattgtttgctatgaggagccagaggctgtgtttgtttaaagcaatggtacccaatcttaagcatgtgtaaaggtctccctgggtctgtgaaccataccttgagaaataactagaaaagtaaaagaatggtgaaccactattaataatacttccattttgcatactaaatatgttgcgtgtacctgtgtgtgtgtgttgggaatagtaatatgaagtttgctcacaaaacactcccactgtgattcacattattttatagcacaaccaataatgattaaacataattatttcctttgactacttttcatttcagtggtaaaacagctgatgaaagttatttgggatggaaagagtaatacaagacatacgcagatggagtctcctgtgcgtaggtttagcacacccatgttagcttgtccacattaggccttcttttgaaggtactgtatctaaagataagggcataagtgatcatttaattctcagccacttcactgatactacaaggtgttacacagtaattatagtggtttgatacagacatttgtttacaagaaactgaattggcattattaacttatttcacacaaaaaaagttagctttacccatgaactgtaattcagattgataaggtgacctacccatgaaaaagacacctgagacctgtttacttttttaaactatgaagtgaaatcctcagttcaataagtgtcccaaggagaatttcctctgttaaattttccctgttaacttagtataattggttttcttgaatagaagaataatgatttctgtaagatattttaatgtgaatatttttgctgtcttcatctttaaaaattaaatacagtactatatatagatattaaaattttaaagtgggactaggtgtttttatgtatacaattacagtttgtctcctctctttgcaaatttactggctattatcagaataaaggttggactcattttgcttatcccagtcattaaaatgttgtgatctgtttctaacatatttagcatttcatttttaaaatgagatgtgccattatcataacaaaggcaactattaatgttcctagaaaaaatgatgtaaaggacttactcctagtcaatattaacacttaatcccactttcttttttccaccaaatggcctcagtacattgccaagagagtgaaatttggattcctcacagtactcagaacacaatatgatatttgtcagctaactttccatcatgtcttggtaaaattgctcagttaaatataattggccatctacttattaaaaaacaattcaaataatctgtacagttaccataatttgacaacaaattactttaaatttagcaccatcttagaaatcttcttaatataaactactgattgaaatgtgtttatactttctatcatatttcaaactgttttactttccttgcattaagacaattaaaacacaaactacatgttagaatgaataatttaaaggacatgctgctgtttcagcataaaaaatggtaaagtctttataaatagaatacttatgatagccattaacgtattgaattgtttaattaacctagttgtgattttccgaatttaagacgttttcttactacatgtgttaaattgttacctataatatcttcctggaaaaatagaagtatttgtaaggtttttataaatgcacaatttatgtataaatataattggaatctgggatgactcttagtaatctactattcttaattcaacgatggccaccagctacctgacacattttgtaaatttagcatctgtgtatgtgtgttcgtgtatgtgtgtgtgcgtgcatgtgcacattactgcatttattctcaaatggatttataatttagtgtttttgtacaagtacttgagctattcatgtaatgggataagttgccataaagatgtacataaatgacccttaatttggcacgttttcacatttaattttttaaaatacagcttttcatatacagttcctaccctttcatttctagcctgtacttcattacttgttgaaaaagtcaagtttgtatgaagccagcataaacatcaaaatataactaatgtgga

SEQ ID NO: 28210 - DNA, 1698 bp, Homo sapiens
gggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcatt

SEQ ID NO: 28211 - DNA, 1521 bp, Homo sapiens
caagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaa

SEQ ID NO: 28212 - DNA, 2543 bp, Homo sapiens
cggaggcggggctggggcgccgggggcgggggtgggaggcggaggcggggccggggcgccgggggcggggcgagtccggaggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaatt

SEQ ID NO: 28213 - DNA, 1475 bp, Homo sapiens
ggaggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagt

SEQ ID NO: 28214 - DNA, 1225 bp, Homo sapiens
acttggctgtgccattgaggcgtcaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagctt

SEQ ID NO: 28215 - DNA, 1217 bp, Homo sapiens
gcaaatgcaatcagacggtcccactgtggggtgtgaagtgtccgtagagctgtgagagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaa

SEQ ID NO: 28216 - DNA, 1528 bp, Homo sapiens
agactgtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaagggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagta

SEQ ID NO: 28217 - DNA, 1656 bp, Homo sapiens
ccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggt

SEQ ID NO: 28218 - DNA, 2339 bp, Homo sapiens
attcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcagtcatttgatctccatctcatctctaattattataaagaattaaaacaagtcatcattgtagaaaagcaagaaaatgcagatagagaaaaagaagaaaataaaactggagtatttccacaacccaagtttagagttggcccccacctcccatgccatggactgagcagcaggggcccagcatcccttggatatggtggctgtgtcttcatgtgaaagaaactgaacttggtggtttttcctgccagttcaggagagattcttggcatgtaatatatatcactgctcaagtcaagcctcctaaaaccacagacctgtttcagctgctacttcagccaaaattcttcagcttcatattgtcttgaaaacctatgattgtctctaacaaacaggctacttgctagttagaaattcttatcaatttggcaagctacttatcaaccagactgaccacaagaactgtcatctcatcaatgaaggagtaactgatcaatgaagccagcaatgcttttttcttggcatcatcaaagctgacatttagaagagatgctggtgatagtcatctcatcctactcaatttttcaaaggcagaaaccaaccctggagcaattgagaggactgtttaaacacagagcttaacaatggcagaattgtatatctcgtgcttaacagattttggttgaactttaccctaggtcaggggtcagcaaactactgcctgtgggccaaatttgcccaccacctgtatctgtaaataaggtttcattggaacacagctgtggccatatgtttgtatattgtgtgtggctgcttttgcattaggatgacagaggtgaatagttgcaacagagactggctggtctgcaaagcctaaaatatgtcctgtgtggccctttacagaaaaagttttctaacccctgctctaggttacggagaaaaaaaaaatggaataatgttctctgctacttttaacctgattttctttgttacctaaataggcagctagaatgctgcctatattttaataaggatttggatctcacaagacaccttaggccttacacaagttgttcagattctttgccccagttctaatctagtgacaaaggcatagaattctcctcccacaggaatgtatttctattttcaaggtgttaattagttccagttttggttttgtcgttttccccatgtccgatgcttatattggatgatttctgataaaccctgactattccaataaaccctaggcatttttgaatttaaa

SEQ ID NO: 28219 - DNA, 1025 bp, Homo sapiens
attcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctg

SEQ ID NO: 28220 - DNA, 1713 bp, Homo sapiens
gcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctttgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 28221 - DNA, 1883 bp, Homo sapiens
ctgccgtgtgaggcggaagcggaagagcaggtctccaggggagcgatggcagccgggggtctgagccgctccgagcgcaaagcggcggagcgggtccggaggttgcgggaggagcagcagagggagcgcctccgccaggtacgccgccgccgctccccggcccggccatgcccggcccgcgccgccgctcaccgtccgcctgcccgcaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctttgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcagggtcttataggggaaatcaataacttcttttaatcaaagggttcaagaaattaaggatcccttcaccttctgggcctggcacttcttgtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 28222 - DNA, 3997 bp, Homo sapiens
tagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccaggtcagcaactggtttaagaaccggaggcaaagagaccgggccgcggaggccaaggaaagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcacccagtctgagttctgggcaactgatacgcctgtttcagcagcctttcttttttttcaatgaatgggaattgcaaatcaactggattttcattatttccttttaatttatatatggagaaatgtgaagagggaaaggaaatggaaagagaaagagaaagggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggttttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaggattggcttgcttgtgctttgtaaaatattgttccccagggagaatctatttattttctgacatgacagtttcataattttgattttttcccatctataattgtcaccattaatatattatttctttcttactctttcctatttctgttctggtctagaaaactgaggtgtgcttggggaaatcaaggccttattttttaaaactgtcaaatagctttgagttccagggagaaatggtcactgtacttaactgtacacacttttacttataaagtcgtttttccccctcagtgatggacagatgtgcacacagccactcagagaccatcatttggtttgggagctcagggtcccaatctcccttgttagtgttttggatcattaagtcggtgtttatttaagtcactagggtgtttattctccctgtcttgggccacggagaaatgccaccctctgcaggaggggctctcacagggaatctcctcacattcttcacattcactccccaaaacaaacaccctgcacaaagatagctttcaatgaccctgacaggcttcaaaggacgctgcggaaatctctctggaaaataggaagggccaattactttaatttcttacatgccgtctcttcctactccggtgactaccctccactctcccagctccgcctgggataattttaggctcgtggaagttgtgtctcgcagggcgccccggcccacttcctgctcccttagttggtgaatcttggaaatgtctgcagatccggcgaggagcaagagcgctggtcctgtaaaagcccccgtgattactgcttgtaaacttgttaaaaggacaattttctgtcacagtcataaactctttgtaaaacccctggcactaaatccagagcgcgcatattccagatgtgtttaataagaaattgcacaatgtgcctccttccgccatcctcggctcagtctgggtaaaaggggcgagcaggaggaggcgagaaagctggatattgctttgagtttttttggcaatcatttcagagagatcattaggggaaactaaccatatttttttcttccctcgaggaaatcttcgagaaccagctgttaagggacctccagtttaccttctgggcgtcgcagtttaactgaatctaaagccacttttcgtttctcctctacagatgtcataacggtagccaaaagtaatgaacaacggcttataaatagtttgtaggacgaaaccatacagcattgtgccaagtgaaatgaaaaaaaaaaaaaacactcga

SEQ ID NO: 28223 - DNA, 2205 bp, Homo sapiens
acgggagggagaacgagtgagaagcgagcgagggaacggcgggcgggcgcggagcatgcggagcggcgccccgggcggcccccgggcttgggcgagggcttgggccaggcgcgcgggccgttggggttcggagcttcgtgggacccgcggccggcgcggggacgtacggcagtgactcggggctcaccgggggccagtgccgggccagggggccagccccgcccgcgtctcggcccggacggcccggcgaggaagctcccatgcgggaccgcgcggcccggtgagggcgcgcgcgggcgggcggggacgcagccggcaccatgtccatgctgcccaccttcggcttcacgcaggagcaagtggcgtgcgtgtgcgaggtgctgcagcagggcggcaacatcgagcggctgggccgcttcctgtggtcgctgcccgcctgcgagcaccttcacaagaatgaaagcgtgctcaaggccaaggccgtggtggccttccaccgcggcaacttccgcgagctctacaagatcctggagagccaccagttctcgccgcacaaccacgccaagctgcagcagctgtggctcaaggcacactacatcgaggcggagaagctgcgcggccgacccctgggcgccgtgggcaaataccgcgtgcgccgcaaattcccgctgccgcgctccatctgggacggcgaggagaccagctactgcttcaaggaaaagagtcgcagcgtgctgcgcgagtggtacgcgcacaacccctacccttcaccccgcgagaagcgtgagctggcggaggccacgggcctcaccaccacacaggtcagcaactggttcaagaaccggcggcagcgcgaccgggcggccgaggccaaggaaagggagaacaacgagaactccaattctaacagccacaacccgctgaatggcagcggcaagtcggtgttaggcagctcggaggatgagaagactccatcggggacgccagaccactcatcatccagccccgcactgctcctcagcccgccgccccctgggctgccgtccctgcacagcctgggccaccctccgggccccagcgcagtgccagtgccggtgccaggcggaggtggagcggacccactgcaacaccaccatggcctgcaggactccatcctcaaccccatgtcagccaacctcgtggacctgggctcctagaacccatttgccttgatgagcttgccttttgtgacttgacactggggacgtggagtggcggtgtccaggggcgccccgcccctgcggccccaccaggtactgaaagacccgcaggctgagcgggtagaacagccgggtagggcagatagctgtctatgttggttcttgtttgggatttattttcaacaagttacttttaggatccttttggggctggagactgagtcttgaaccacagaagggaataaattatacaccactgtcattctctctctccctctgtctcttccttttaccctctcttgtcttgccttttccccctttcctcttcctttcccttccttctcttttcttttttctgctttctgtctttctccctctccttgtattgctttccttctagatttctagcttgccaccgttcattctctccttctgtctctccctttctctctccttctctgtttctcctctcttctctcctgccagtctcttgtactctgtgtcctggtccctccgtatgtacccctgtctttctcctcctgactggtggtctatctgcccctacctctggccctcgctttaccggagtagggggtgggagagggaagaggagagaaaatacagggactttgaacctaggccatctcctgaggccttttccctcgcccatgtgggtcagtgggagctgcaggtgtcagcttttcgtctagtaacttaagtgagagagaaagggcagcgccacagaagcccctaaacgccgcctcgtcatacgcccctcctccttctctcttggcgaggccccgccacaccgcgctcttcctcccgggactgtgactacagcgctcccggctgagcgcgccccccgagccgccgacttgccgtctccccgtaatgccctcatgtgaatgttcttcgggaaatatttctgcttttattttataataaaattagaaatcataaatatataaatggttatatgccacaaggcccgcgggccgggagtgca

SEQ ID NO: 28224 - DNA, 2658 bp, Homo sapiens
gaatcgctgaatcttgactcggcggtggttggctctccctctcctctctccctctccctctccctctctgtctcgggttctctctctgcgcgcgcgcaccgggccgctctcctacctccctctctatgtggctgcgcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgttaaaaaaaaaaaaaaaaaaaaaaaaaaggacagggggaaaaaaaaaaaaaaagaactcctggagagggaaatagcaaatgtgtcttgccttttgttgctctctctctctttttttttctctcgctctctttctttctcttcttctctctgtttttaagtcaagtattggtcaaaaaaatgcaatcttctgttttttgttcagcagacaatcattttcttcgtaagcacctttttctctccactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctctcctctccctctctctgtctttctccccgctcaactgtctcttttctttttggggttctcctcccactcggtgctcctggtgtcgacttggcagtcaaggagaggcatggtggcctgggttaggaagagggaccctgtcgctagcaaaagcggagagtgagattgtagtattcttatgcaaaagctatttccagtatttcttagcagcttcagaggtatctctcactccctgtagggcgcttttactgttatcttaaactgcgtgtttatctatatgtaaaaactttctaaagcaaatacagtattctccattttcttatcactccca

SEQ ID NO: 28225 - DNA, 6285 bp, Homo sapiens
ggaaagaaagaggaaaagagtgcgagggagtgagggagggaggaaaataaacaacaaaaaatgtcctcttcctcccccaccgggcagatcgcaagtgcggcggacatcaagcaagagaatgggatggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattctctccactgcagctgccccctgtgtcagtggcagcttcacaaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcatccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtacatatttttaaagttaagtagcatgcatatatatatgcacacacacctctttttcagcattttttgagaaagtcttgggtctcaaacacatttgtctcaacacatttccaaatgtgatttctaatagctcagtgtggctgagaaagtgcggaactccactaaaaactctgaaacttcagtataaatgtaaatatatcagttctataagcaggatttgagtaattacagtgaattttatttttaatgtatatgtttctcttcaggcgctatgaactgaaaaatatgttttcttactgtttaatttatttttattgtttgaacaggaagtgaacatagtcgtttccaacaaagttttactttttgtaggattttaaaaataatgatttttaccaggaatctattaaggtcaatattaataacactgaaacaggaaatctaactcccaatattggaattttggtactttttttcacatccttgttctttatttagcaactctgattcatttaaatatgttttttatagaattctatgtgcctttttacctcgtggcctttttattggtagtaaggtacagaagtgtcaacagaagcactgatggttcttttctactatctaacagggttaatttcaccacaaaattgctttaaatctgaagaacttaagtttcactaaataatatatatgacatttatcacacaaatggataaacaactaattattgttgatacttttcattacaaggaaaataagttataaataccatgtcaaattgattatacaggctatgaaaaccattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaacacaagatgtaacaatgcaaataaatttatgtagtgagtaaagttgctctctagtctctgaaaagcaaaaaaagtgagaaaataatttcttcagagataacttcaagttgttgaacataaaggtgttagatgttagcacatcttgctttttttttttttttgagatggagtctcgctctgttgcccaggctggagtgcagtggcacgatcttggctcactgcaagctctgcctcctgggttcacgccattctcctgcctcagcctcccgagtagctgggactacaggcacctgccaccatgcccggctaaatttttgtatttttagtagagacggggtttcaccgtgttagccaggatggtcttgatctcctgacctcgtgatctgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcatttttgatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataactggaaatgttttatatgttttccgaaaatacaataagcctctcttttattcagtgttcttcctcttttctcccttatgaaaaagaaaagatagcacaaaacttaagacttacctaggaaacccattcatattcccaccatgatgtaattataaccctacaattacttcaggtagctacacaatataccaggtaagaatcaatgcacagtataaagaacttattgttcttttctattctttcagttgaataagggccagttggtatgcagcccatgtatatgtgaatggagtaagataaaccccatgatctccttgcacagaattgcaaatgtcttttgccataccaagggccagactcagaacccttggagtcatgtggcagaatttccctcttacataaaccaatgcttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatatcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaaacactatgctaaataaactttatatttatacataccttgcattga

SEQ ID NO: 28226 - DNA, 2974 bp, Homo sapiens
ggaagagagggagggaggaacttcccaaagttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtgaggcggcggcggcggccggggccggggcgggcgcagcggctgcgggagctgagggcccgggatccccgggcgtccccgggtcgccccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagagcgagtctgatgggaatcccacgactgaggacgagtccagccgaagtcctgaggacctggagagaggggcggccccagtgtccgccgaggccgctgcccagggctccatattcctggcagggaccggccctcccgcgccttgcccggcttcctcctccatcctggtgaacgggagcttcctggcagccagcggctccccagcagtgctcctcaacgggggccccgtcatcatcaacggcctggccctgggcgaggcctccagcctgggcccgctgctgctcactgggggcgggggtgcccctccaccgcagcccagccctcagggggccagcgagaccaagacctctctggtcctggaccctcagacaggggaggtgcggctggaggaggctcagtcggaggcccctgagaccaaaggggcccaggtggctgctccgggaccagcccttggagaggaggtcctggggcccctggcccaagtggtgcctggccccccgacggctgccacctttcctctgcccccggggccagtgcctgctgtggctgccccacaagtggtaccgctctccccacccccggggtatcccacgggcctgagccccacctccccactattgaacctgccccaggtagtacccacctcacaggtggtgaccctgccccaggctgtggggcccctgcagctgttggcagccgggccaggcagccctgtgaaggtggcagctgcagcaggccctgccaatgtgcacctcatcaactccggggtgggcgtgactgccctgcagctgccttcggccactgccccaggaaacttcctcctggccaaccctgtgtctggcagccccatcgtgacgggtgtggccctgcagcagggcaagatcatcctcaccgccaccttccccaccagcatgctcgtctcccaggtcctgccgccagcccccggcctggccctgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacc

SEQ ID NO: 28227 - DNA, 2787 bp, Homo sapiens
gacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccggcgtgcctgagccgagccgagcccgaaccccaagccgcggagccagcacctcctccagtcggggtcgtccgctcccggccgttgagccaccgccgccacccggtagtgtgtcccgctgccccaatccgcctcatcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattctcccatgggtatttcacgtcgaaaggacgctgttacatatgtataactttcgctttaaagtttttttttaacaaaacatatatatgctgtttatttacttatttaagagaccgccatggtaggtttctctgtagcttggggaacttgctgtttctaaacatgcaggctggtggtgatgggttctgtgtggagaagccaaacaataaaacaacctagtgggcaaccttcttaattaagggagctgctctcagattccttttcttcttattattattaatatcattcccttcaccaggcatgcagggacccttgagcaaatggtctccggaaggtcttacctatatatcttttgccttctttggtgcttcctggtatatgttttaaacaacctatggtaggtctataaccacctcccacgtcaaattacacgtatgtgcatatatgtatgtacctatacaaacatatgtatgtacctatacaaacatatgtatgtatgcatacacgtgatatatttaaggctagaaattggcaacatgtgagcgtcctctctaaggcaagtccccgcatccccagcacaggtaattatggcttgtccacttgacactcgtttacatgaagtgtcaacagctttcaggagcaatttaggaagccaaactatgggactcaataagtgagtcctattttctaaaaatgcaaaactatcctgactcaggctctgcagcaagaaaggctttctgtctccttcaaggccccctccaatacaaaagcagcaggcacccatgatcatgctagagtgagcatatactgcatttaggattgagctattattaaaataagacaaaagatgatagaagaggttgtaaataattagactaacatcttcttgctgcagaatttggttttaatcaaatgaatggtttttaacaagagggatactgagatgggggaaaggatgtaatcatgtcacatactgagggtaaaacaaggctgtagaaataactggcattttaaaaacctaatctccgaattaagcatagaacaagtcatcaagggcctcattgtcctggtaatggcctcgattaaaacataaaatatttttagcatttaatttttcctcgtgcacatgcatgtatgcacctatacatgaacaaatgcatgcatatacaacgcaaaaacatctaccatctttgcactaagaaaataaatgctagccagagtctctaattttgttcctagtgaaacagattgcatattataaaatttgacattgatctttaaa

SEQ ID NO: 28228 - DNA, 896 bp, Homo sapiens
ccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgtaaagatc

SEQ ID NO: 28229 - DNA, 730 bp, Homo sapiens
aaacattgactgcctcaaggtctcaagcaccagtcttcaccgcggaaagcatgttgtggctgttccaatcgctcctgtttgtcttctgctttggcccaggacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgcagagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcc

SEQ ID NO: 28230 - DNA, 2712 bp, Homo sapiens
cagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgcagagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatccctgtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaa

SEQ ID NO: 28231 - DNA, 2743 bp, Homo sapiens
agtttatgacagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatccctgtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaataaaataaaatgaaatagatcttat

SEQ ID NO: 28232 - DNA, 2559 bp, Homo sapiens
cagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 28233 - DNA, 2365 bp, Homo sapiens
gcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 28234 - DNA, 2689 bp, Homo sapiens
gtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 28235 - DNA, 1355 bp, Homo sapiens
atacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaaga

SEQ ID NO: 28236 - DNA, 1039 bp, Homo sapiens
aatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgac

SEQ ID NO: 28237 - DNA, 913 bp, Homo sapiens
cagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggc

SEQ ID NO: 28238 - DNA, 1352 bp, Homo sapiens
ttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaag

SEQ ID NO: 28239 - DNA, 2996 bp, Homo sapiens
acttttgggacatcctgttctgagtcaagattcctccttctgaacatgggactttccagaaggaccacagctcctcccgtgcatccactcggcctgggaggttctggattttggctgtcgagggagtttgcctgcctctccagagaaagatggtcatgaggcccctgtggagtctgcttctctgggaagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcggcaacttctccgtgttgatggtggacacaaggggccagccctggacccagaccctccagctcaaggtgtacgatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttcccagggtggcttcaatctccccacctaggatgtcagccctgtccaaggaccttccctcttctccccagttcctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 28240 - DNA, 1038 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatattt

SEQ ID NO: 28241 - DNA, 1937 bp, Homo sapiens
atgggagggaggcaccacctccaaaggcaggttagtgagagcatgtctgccctgttccaggcagtgcgcctggagagcgcctgggcggaccgggtccggtacatggtggtggtgtacagcagcgggcgccaggacaccgaggagaatatcttgctgggagtggacttttccagtaaggaaagtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatg

SEQ ID NO: 28242 - DNA, 2432 bp, Homo sapiens
tttttcagccaaaatatcagaggaagacaagagttccacaagagccatttgcttttcgggtaggactctgaggaggagttggctccccagccctcgtggaagcactcggcagcctcctggcttttcctgatctccatagggagcagatggccagagctcggagggcagttgtagggagcgttagagatgtgagcactgcagccacgaacctcttttattttaccgacttctgcatcttccttcagccaacccactgcttctgctgtccagaggtttccagctcaaattacttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagcc

SEQ ID NO: 28243 - DNA, 8538 bp, Homo sapiens
cggctccaggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaattc

SEQ ID NO: 28244 - DNA, 8488 bp, Homo sapiens
aggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaattcctga

SEQ ID NO: 28245 - DNA, 2354 bp, Homo sapiens
cggctccaggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagccaacttca

SEQ ID NO: 28246 - DNA, 9327 bp, Homo sapiens
gcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctcaaaaaagtcattttcagagaacacctttatcaaaggcaaattgctgtttttcagtcagctgccacctgcttctcattttgccctctgagaaaaggcatggtttcttaattgagggaaggaagcagattcggaggggtggagataaagctggggattggagatgttcccctgcctttgtgatgatggtttggtttccagacctgaggcatcgaatgggctaaaggtcagccagaagtcagagggctctcagccttcatccagccgcagccctttagagttcctgaaggaggcaggttccgctttgctttaaaagagggtcttccggtgttccagagtgtatcgttacagtaagacatgataatggccggctctgcaaatttatcatatagtttttttcccaagaaaattatttttgaaattaaaacaggaccccaaatgaaatccaagtggtcttctgtagaggaaagcatgataagaggaggaagacataaagttgggggtggagaggctgctgcccagaaactgctgggttggtgggatccacacagatgggcatcttggctctccctgccagaaaaatgtgctctgcagtgtcctcccaactgaaaacaacagtgacatgtttgaaaagcagcaatcgaaagtcagtgtgttcttgtaaaatgaatatgtatgtagggttttaacccttccattacttgaataattctttgggccttctgagtttaatggccatattttcttccagtttattttccttccccatgctgttgtccccatgctgcctatttttttaaatttcatagattatatttgaattgttacatatgtttaacatccattgaatgcaacgttttatttttggtattatcactgttaacacttttttttccttttcctggaaggtttgtcatttctctaaagtttgtacacagtatttatgtacataatattgtcactgtcttagtgtcttgttcatgttgtagggtaattttgatttattctttttaagaaggagtagagttgcaactggaaaacacagacaccagaaatgaaagtgttgggtgttgataggaatctgtacaatatgttgatggtggctgtagttgtttaaatggagacttccaatcaccagctcctgccaaattatgcattagtaactttttcctcagagacacccctaaaggctcccattaggtcacagcgtgactgaaagctgatttctctgtgagactgaaatcccagaacattgtttgccagtatctcaaccacagccaggaagtatatgtgagttgcccagagtggaagctcctagtagaggctgaaggccacaggggaggcctcagccaggggcaagtgcccacagtgactccatttaggatgctgtcgttttgctactgttgtggagatccttaacgcagcagcgcctgtcataaacaagcctcttgtagcttcttacagaaaacagatttagtctagcatgaaacacctctgcatctcattgaaactgaagaggcttgcagatttgctttcgttgatgtccacgttactgaggattgactgagtatagactggagacaggtttttggcttatcacagcactgaggaaaatacaaatgcacagactgtcagcatgatgtcagaggccagagtttggtgggggcagatggcagggcgacccaaaagatgcagaaaaggtagactggggccactgggtcttaagaggagctgtgaagttgtgtggaagccaaggctgggtctgacatccctgccaggaagcaggttggacagaaaccacttgctaaaagcgtctctatggtgcagtgattatgtgtaccctgtgctgttgctcagtagtctccttgaatgttcaagtatctcatccactcagttttgtgattcctggatatttgtgtgttgtaaagtgttttgttaggtggtatgaaccaatgtgaggaggcttgagacagggttatggatttccagagctcttccatgtagaataccctgccttcttgaagcagttccaccaccaatatgatggggaagggcaggaacttatggcagggtggggagagggtttgcctggaagttaagagagtggcatccacttgtggtaaccccttacgatgatgacatcccacacactaagaggtacaagcaggaccaaagttttggactgttccctcttctcccctccactgtgtttaatgttcactcactgcattaaataacaacaaagatgggacaaaacccactaatactgtggggaaaaaaaattttcaagagcagaggaaagtctttctgcctttttataattactttttttatcatttaatttacctgcctaaataaacatcttctacagaatatctgtcattcaaccatgccaaggagtttgtgccagccttttcagactcccagaattgggtgttcctgggttatttacatagctgagcagtgtccaggggaggtgcgcagtgaactgtcaaggactttccagactgtcttctcttcagacttttataatctccagtggcatctttcccttttcttttgttcatgacctgacctgaagcagcagatttgatagactggcaaagatgaataggaaaaactttgactcttgcccagtgcctgcctgcctctctctctctcctctctctctctctctttttaaaccaccatagactctcacttattttggaggagtgtatgtgcatgtgtacacatatgtacatatataaaaacagttgatgttttggtgtatggggtaaaagccccaggagcatacagaacttgagctgaacctggtcagtagaaagggaaaccccaaccctttcttgatttttggagacacccaggactaatggatactgtagtagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaa

SEQ ID NO: 28247 - DNA, 795 bp, Homo sapiens
atgaccctgagcacgttggcccgcaagaggaaggcgcccctcgcttgcacctgcagcctcggtggccccgacatgattccttacttctccgccaacgcggtcatctcgcagaacgccatcaaccagctcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattg

SEQ ID NO: 28248 - DNA, 1796 bp, Homo sapiens
atggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaaggtgagtcagtgactttctccaattctccctccttttaagttccctaaagcaagatgaagtgtccttctctgtagctacttctcaagctgatttggatgtgatattttttcaaaaaagacttatttctctatcaatccagttttcaaaacataagtgtaagcatttaagatttgcatgggctggccgggcacagtggctcacgcctgtaatcccagcactttgggaggctgaggcaagcggatcatttgaggtcaggagttcgagaccagcctggccaacatggtgaaaccccgtctctacttaaaatacaaatattagctgggcatgatgatgggcccctgtaatcccagctacttgggaggctgaggcaggacaatcgcttgaacctgggaggcagaggttgcagtgagctgagattgtaccatgcactccagcctgggtaacagagcg

SEQ ID NO: 28249 - DNA, 4538 bp, Homo sapiens
ccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcgagctctcatttggaagacagtgaatcagcagcattactttgctgtgaatgtgaagaatcagaaatctttactgattccaatgaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaatttt

SEQ ID NO: 28250 - DNA, 2871 bp, Homo sapiens
gagaagctccgcgggcccggctgggcgagtgtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggtta

SEQ ID NO: 28251 - DNA, 5185 bp, Homo sapiens
cgcgctctcttcctccctcagacaactcgccccccgccctccgcccccctccacgtaattccgaaagagcagaagaaagagaaggagaacaggaaaagaagagctagtaagcgagagcgagagcacagaaaagaaaaaaaaaagccttaagaggaccgaaggggaggaaaggaaaaggatggacaaccacaaaacgcagcgattgcggaaattttccagcgccattggctgggcagcgtgagtccttcggtcgggcgtgatttcagcaccgggggaactggacagcacctcggggggacttctgggcaacccgcaaccacagcaagaactccaccagcagcctcaacaacagaagccgcggaaaaccctgctttgtatcagagaggcaaggtcagtccgacgcacagccatgcacaggcagtgcgcctgtactacgctgcaaaccctctgcttgtttctctaacatgcacttgcttctaattactagcattgtttcatttctgatcagtgaagatcagtagatgagattctgtaagggtgtacttttaatttatatgtatatatttaacttctttttctgttatttttaaagtgttgtgggggagtggggtttttttcctacttttttttttttttttttttctttgcttgccttgcactacgtgcctggatagtttgtggatataattattgactggcgtctgggctattgcagtgcgggggggttagggaggaaggaatccacccccacccccccaaacccttttcttctcctttcctggcttcggacattggagcactaaatgaacttgaattgtgtctgtggcgagcaggatggtcgctgttactttgtgatgagatcggggatgaattgctcgctttaaaaatgctgctttggattctgttgctggagacgtctctttgttttgccgctggaaacgttacaggggacgtttgcaaagagaagatctgttcctgcaatgagatagaaggggacctacacgtagactgtgaaaaaaagggcttcacaagtctgcagcgtttcactgccccgacttcccagttttaccatttatttctgcatggcaattccctcactcgacttttccctaatgagttcgctaacttttataatgcggttagtttgcacatggaaaacaatggcttgcatgaaatcgttccgggggcttttctggggctgcagctggtgaaaaggctgcacatcaacaacaacaagatcaagtcttttcgaaagcagacttttctggggctggacgatctggaatatctccaggctgattttaatttattacgagatatagacccgggggccttccaggacttgaacaagctggaggtgctcattttaaatgacaatctcatcagcaccctacctgccaacgtgttccagtatgtgcccatcacccacctcgacctccggggtaacaggctgaaaacgctgccctatgaggaggtcttggagcaaatccctggtattgcggagatcctgctagaggataacccttgggactgcacctgtgatctgctctccctgaaagaatggctggaaaacattcccaagaatgccctgatcggccgagtggtctgcgaagcccccaccagactgcagggtaaagacctcaatgaaaccaccgaacaggacttgtgtcctttgaaaaaccgagtggattctagtctcccggcgccccctgcccaagaagagacctttgctcctggacccctgccaactcctttcaagacaaatgggcaagaggatcatgccacaccagggtctgctccaaacggaggtacaaagatcccaggcaactggcagatcaaaatcagacccacagcagcgatagcgacgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggaccagttaacctccatcatccagatagacctccacggaaacccctgggagtgctcctgcacaattgtgcctttcaagcagtgggcagaacgcttgggttccgaagtgctgatgagcgacctcaagtgtgagacgccggtgaacttctttagaaaggatttcatgctcctctccaatgacgagatctgccctcagctgtacgctaggatctcgcccacgttaacttcgcacagtaaaaacagcactgggttggcggagaccgggacgcactccaactcctacctagacaccagcagggtgtccatctcggtgttggtcccgggactgctgctggtgtttgtcacctccgccttcaccgtggtgggcatgctcgtgtttatcctgaggaaccgaaagcggtccaagagacgagatgccaactcctccgcgtccgagattaattccctacagacagtctgtgactcttcctactggcacaatgggccttacaacgcagatggggcccacagagtgtatgactgtggctctcactcgctctcagactaagaccccaaccccaataggggagggcagagggaaggcgatacatccttccccaccgcaggcaccccgggggctggaggggcgtgtacccaaatccccgcgccatcagcctggatgggcataagtagataaataactgtgagctcgcacaaccgaaagggcctgaccccttacttagctccctccttgaaacaaagagcagactgtggagagctgggagagcgcagccagctcgctctttgctgagagccccttttgacagaaagcccagcacgaccctgctggaagaactgacagtgccctcgccctcggccccggggcctgtggggttggatgccgcggttctatacatatatacatatatccacatctatatagagagatagatatctatttttcccctgtggattagccccgtgatggctccctgttggctacgcagggatgggcagttgcacgaaggcatgaatgtattgtaaataagtaactttgacttctgacaaaaaacaaaaagtgctgcatggctcgcatggaatccacgcgctccagggactctgcccgcccccgcgactggagacggcatctcgttcacagcacccaccctcttacctgataagttccatcgtatcaaactttctataaacaaaatacagtataatcagaaagtgccatttcgccattatttgtgatcggtaggcagttcagagcataagttaactgtgaaaaaaatgtaaaggttttatttaggacatttgcatggctagtcatcagtccattttatgagttaacaatgtattttgttgagggaagtttttaggggttgttttgggttcttttattttgatggtgatgttttattttattttatttttttcagggggtcttttttttaatacatatccaataatgccttccatctgaatgtaaaataagtacccatgatttctattatagtatcagtgtaattatttaaaaaatgattttgaggcagttaagcatgaccaattaatgtcactctagtgcttaggctgcgatcctatggtagcaattctgtgctggtataaatcttacttataaagtaggaaaagagaaccgaggaagcacgtgaaacttactaattctattcgaggattttataatggcatattttttcagtattaaagcgaaaatgttttcaactctgggtccttacctttttccagcttcatatttgcaagtggtaaattggatttgcggtggaagagacaggggagggaaacggttggggttagatcccttcctgagctacattaaggctctttctctaatcgccttacttagctttttaccctttaagtagctcctcttccctcgcccccaccctctaccccacccccaccttcgctcagactttaccggctttccccagtccataaaggtcttgccccaacactcaccccttctttttttcccctctccaaatgcagcagtgaatccctttattaatactggaaatccctctctgctgcttttgttggtgctgcccacactgcagatatattaaggatgttaggagagatttgatttaattgactctgcctagataggtctcattaaacagagtggagatttcattggtcagcactcctcaatgaaagacagacctaatgactggcatttgagatgctgctggcattttgaattcaacatctgctgaaaacggtaaaactaattagtgcccacccaccctccccgccccagcaactgcatattgaaatttgttaaagcactcatctttatggaaattaatcattatcctaaagaagtgtttctctcccatcatccggatttctggttgtggcccagcaattaacaaaaacagcttcaactgttcgaattttatgaaccaatgtaactctggcctcaatcatattcctctgggatttctaaacagcagttaagctacaaaaagcaaacaaaaccacacatattgatggagtctgcattccaccacatatccacccttgagaagtatgtcaaaagactgcagactatagatttttttttaatataggattataaatcagctagtgaaagacctcagagcagttgtaagtagatctgccatctagaactcatattctaaagggaagtgatttctcagaacagtgatgttctggaatatgtattatttattttaacacttttttaataaaatctttattataaacc

SEQ ID NO: 28252 - DNA, 3159 bp, Homo sapiens
cttcctgcaagaagcgttgcccgttggctagctgctcggtggggatctgcctgccctgggggcgccgcccgcgctccccgcggtgctctcgctcctgggctgcgccagtccgaggcggtgccggctcctttgcctccccgagtcgcagatgctgcgggcgcctccgggaaaagatctgggcggcgcgctcgctcgatggacacaggaagatccagaagctagtggcacatctagcaacagagccagatcagaacccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggag

SEQ ID NO: 28253 - DNA, 7672 bp, Homo sapiens
gcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttcgcaaaaataatctgtcctcaaggaatattgaaagcgtcatcaatgtcttgaaggaaattactgtatctgagaaccgaaactagtatttgatgtttcactttcaaatacatttttttttaataaaaaggatacctttaagtaaaacactaccactgctatttacgtttaagtagatttttaattcatattaagcagtagtgtgctttttggaaagatgatggactgggactcataatccctgggttttgtttctatttgtagtttcttgagtaagtcagcactttccctggttaagaaatgacctcatctgtaaaatgaacctgacttctaaggtcttgttcggctctcacgtctttacttcagttaaatattgacataatacatgtttgttgaatgaatgactgaatgaataaatcttattgctctaggaactatgtgcttttaacctttggaaatacatagaaacaaatgcctcctttgctaggaaagggagcttaattgtgctcccactgcatcagactgcttccatctaatgatgcaattgcaatacagggtgggaggccatccacagggctgtccctctgcctcagagctcatctcaagtttgcccttctctatggagaaggaaaatttgagtctccagaaggaaagtattttgctaaacgccaagcaagaattagagggtaagggggcttctgatgcctggtccaaggctcttagaagaagaagaaggagaaagggagaaagctcaagaaaataatgcacagatcaccagctacaggtggccctagtgcctaagtttataaactacccccgcccttcccggagagaaaggagcttgtataaagggaacaatcctagaacctaggcttaacaaggaaggagaaggggagaagcaagggtcattctgttctcaagtggtttgttgtatctgtgtgtttatctattccacatttggccaggcagtgggactccgggaaagcaagctgaagtgttttgtgggacaggcacatcatttggtcaactccttttccctggttgattccctccttttcctgacccatctcccccttcctaccagaggcaaccaaggcctttccaggcaacagcagacattatttaccccttgcgaattgattccacaatggaagactcttgggtccaaggagctgtaagataattaaggagaaaacagataatgaaggcaaaaatccaacacctggccattagcaatgctctggaaaggctatttaaacccgcattggatatcagagctgggagggcccatacagtctacctacctgccttttgcagatggacacaggaagatccagaagctagtggcacatctagcaacagagccagatcagaacccaggtaagctcggtctcaggccaggattccttttccatctcctctctttctcaggagccagtcttcctgcaccagcttcctcttttctcctagctcccctgcccctgcagcctggagggctcaaccacccttcctttggctcccactcccagctgaggctcagcctggcagtgcttttctgacacccacttcttttctccttcctccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaa

SEQ ID NO: 28254 - DNA, 4142 bp, Homo sapiens
gttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 28255 - DNA, 3995 bp, Homo sapiens
gttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 28256 - DNA, 4154 bp, Homo sapiens
gttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 28257 - DNA, 5431 bp, Homo sapiens
gcctccccgagtcgcagatgctgcgggcgcctccgggaaaagatctgggcggcgcgctcgctcgatggacacaggaagatccagaagctagtggcacatctagcaacagagccagatcagaacccaggtaagctcggtctcaggccaggattccttttccatctcctctctttctcaggagccagtcttcctgcaccagcttcctcttttctcctagctcccctgcccctgcagcctggagggctcaaccacccttcctttggctcccactcccagctgaggctcagcctggcagtgcttttctgacacccacttcttttctccttcctccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaaccc

SEQ ID NO: 28258 - DNA, 4391 bp, Homo sapiens
aagccgggattttgcctgcgatgcgcggcgagaggactgcggcggctgatttacacagttggcgcggaggaggggccgggggtgcgggggggacgcgctggcggagctccggcgatgggctgatctgggggctcccgagcgccgctcccttggtgcgcgatttgggggcggctgatggatttgcattcaggttccagccctgcgtttcctatattgactccttatacacgacctggcgctccagtttaggaggagacgttgttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacat

SEQ ID NO: 28259 - DNA, 4555 bp, Homo sapiens
aaatccagagactgagctcaggctctcgggaacaacgaagctctccactgatccagagcaccgagattttaaatcaaaggaacctagtcctgggacactcactctgcctgcctgcctaccaaccatcgagggcatagggagctgtggtcgtgagctccctgtcgctggcatcgccgcgctaggtgcgcgccccgctctcccattggtatgcagcgaccatttccctgcaagtctcaaaggtggaaacatttaaacggattacaagcgtgattcggtagcctttcggaaagttggtggccagaagaggagaagctacaaggctacagtatgatggatacaattcagcttcgcagagagtttgcccctcctgctgggtagcccctcgcagcaaacctcggagatcctgagcgctctgcaccatagttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacataa

SEQ ID NO: 28260 - DNA, 585 bp, Homo sapiens
acaaatcaatccacgggtacagaatgctgacttcccgacactcaatttcacagggtgtctcttgaagagctgccagttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacg

SEQ ID NO: 28261 - DNA, 3357 bp, Homo sapiens
agtggtcgagtgtcgggaggaaggactgcttgtgtgcggggtgggggggggtggtggagagcgggggcggggattcagcgcgtgtatgtaaaggtgcagcccgtgtgctaggcgctgggtgcgcgcgcggtgtctgctcgggtgcgcgcgcgcgccgctgcccgcctgcccgccggcccgcctgctcgcctgctggggctgctccgtgggtttgacgggcgagcgggcgcggaggagctctgtccggaatcacatagataccatcgtggaaacagcagcgcaggtcacggcgccgcgggccctgcaccagacgctgggctctagagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagtggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagt

SEQ ID NO: 28262 - DNA, 3074 bp, Homo sapiens
attccaggagccctccgttctgcggggtgacaattagccaaagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagtggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagt

SEQ ID NO: 28263 - DNA, 8555 bp, Homo sapiens
gtacaggtctcgggtggctccggctgtcgggccgctgggctgggttgggctttatttttgcaccccactcgcagccactttccgcagacgtggatctgaggctcggggcagtggcccgcgggttggtcggagattgctagcgctcggcaagactaggaataccagaggaagagccgattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagtggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagtaaaaaaaaaaaaaaaaaaaaaaaaaaaaaaaaaaaaaaaaaaaaaaagcatgcaaagagagaacactcgatagtatttgtaaattggtaacctttatggcctgcatcttgaaaccgctggatttataatgttaatttgtgcaaatacttgtttaaaatataacatacattacataactataaaataaatttgaacactttaagcattacctgtctatacataaaaatctaaaagaaaaaatcaacgtgagttagatagcatttgtgatgatctgaagaaatatgtgacgtttatcagaattaaacatggctcaaattaaactaacactagagtttgttctcagttacgtgaaacacccacaatccttcaaggttgtccaaaataagcagagtgcttactgtgtgagcgcacccaaagctatttttgtaacataattcatatttatgaagtactttgtatactaaataggaaaatatgtactccttaatatgtatttaatatgcctgacttgttttcctgatcacagtgaatttatcagtaagtataaatgtagacagaaagaaatatactaaactgaaacaagctggtgtgaacagaaatattctggactttgtgatcaggtgtaacttaaaaacaaaaaaattttaaaacaaacagaaaagaaaaaaatacaaaagaacagtcaattctgtgctattcttgtgaatttagcgtattatcttcagatttgttaccaattgtgcattcaaaaataagttccttagttttctagtattgtgtctggggcagttgttatttgccatcggttgtcttgcttttcaggattctatgagcttaattcaaatagttttcgctacaagtatttaaaaaataatgaataaggttaatagttatatcttgtatgcatcagtatcctgttctttcatcattcagactactatcagataatctagtagaactgtaaacatcatggtaatcttggctatgaaagccacactgtaaaaatgcttgcattggtttcagatgagttcacagtctgcaactacaaatgatatgcccctgtgtttgcttttgctaagatctaagtcaaaatttgttaaaggaataaagtaactgataatgggtgatgtcggaacttttgtaggagctcccgattaacaaagtgatattcagaaacacattgtcttcttggcctgcctgcatatatatatatagatatatagatatatatagatatacatatatatatatgtgtgtgtgtatatatatatgcgtgtgtatatatatgtgtgtgtatatatatacatatatgtatgtgtgtgtgtatacatatatatatagtgtgtgtgtgtgcatgtgtgagagtgtgtgtcctatctcttataattaccttatgaatcagtaagataaccaagaaggtaaacatagccattcctcatgattgcaagtggcatattttttctgttgcagcttccaaaatgatactatgtttatagttgcagtagctgttcctttattaatcactaatttcagggctttatgtgtttgttgcaagacaaaaaaagaagcttggctttcttgggtgtgtgtgtatgtgtgtgtgtgtctgagtgtgtgtatatatatatatgtgggtatatattcatacatatagataatttggaaatcttttttaaatagcaaaaaccgtctccatgtgtatgtgctggtgctcttaaaactttagtgtgtaattttaatttttatgacatctgtgaaaactttatatgaatataaaataattcaaacaaataattgctttctgatcttgaaagaaaagacaagatgtgtgcccaacagcttttttcatctacaatttcataaggacttttgatatgccattaccatgcatgcacacatccatggattaaagggctcctaatgtatactgacaggataaagatgcaaaggcttcaaagaaagtgttttagtttagtctgtcaataaagtatggcttgaaggatcttaaatagacacttataggaggaatcagaaagttccattcatggtctggggataataggtcatttgaatgatacttttattcagtgtggtgatgttctgaagatgtttcaaggtttctgcagaattctcaatggcaagagtacctgccaccatctcaaaagcttgctgtagcatattggctatctcatactcttctgctaaaaggtataaatgttcaactttttttaaaaagtaatttaacatatgtggttatttggaggttcaaattgtaaatgaaagtaacaaattcttggttaaggctaatatattttccttaactaaagtcattgtgcctacattatatagtgtacacaattttgcacctgtctctcattagttctagttgtacattttatgataatgtagttaggtataagttttgagttgagtacaagaacagttaaaatactgtatctacattttgttggcttcaactataaccttgatgttagtttaacccctggaggtatgatatgtacatcagtacagcatttttagtggaacttggatgcaaacctataaaatccaagaagtgctcatttctaatgtgggctgacacatcatgggcttcttggcactatagtcatgggtatggactacgttagaatgattgcaaacaaatttagatcttatgaaatcagtgaaggggttgagataatatattgtgtccatgtaatataaatcaagttttaaattatttttttatgaaatcaataaagatgattcaattctttaaaagtaagactttgtgtaattttatgagaaagcagctattaaagtagagtgattcaagtctataaggcaatttatattctatatttagtttttcattctgaatagactgaaaaaatatatgaattagaaatttatttaagaccatctttcttttgttgctttttttaaacatttacttttctttaagccataaggatgcataaattatacagggcatgaccttatgagtaacatcaacaggtatttcagaaataacagaacacgtctagaaatgtatggtggtaatattaatctataacattttttgcatgatttgtacattgacattgtatgaaatgagcacactgaggtttttttgttgttactgtcgcatccaaagagttggggagaaactatattaagaatgtatttataatcactattttaaaataaagtaaaaaaaatattgtattgtttttaccctgatttgattatcagtattttaggttaatttgtaagagaaaaatcaagtaatgctgtaaaagctcatgtaaatcacagaaaagaactgttttaatgacttttgtttgcttttaataacatcaaggtattagaatttattaattgccatttttatgaaagtattaataaaattgtttgctacaatgatatttctgaagccacagtttgttaaatatatttgtctttccattatttttcagaaaaatataaagcagtaaccaaactgatcatttcacccagatttgagggtaagatatagctttagcctactgtttatattcaacttaactgctaaatctctgttaaaaaaaaacgctttctttagaaacatattttcaatctgtgttccttcccactggcagcccctttggagaagagtctgacagtgccaagatcaacatgctttgattcttgcccattcttttgaatcagttggattctgacataacttcagataagcaaatactaatattcagtcttaactatctgctcaaatacttttagaaacccttcagtacctctgtattccattgccagtttgcctggttacaggttagttacccacttatggagtgaattgtgatttgtatttggttcttttaaagatgaccaaaattatcaatccatgactttacccaaattattactgttgtggaaaatgaactaattgcattacggttaacttgagggcagaaatgaatgtaactgactatattgaccaatacggtgggtttaaggttcatatatttatggtaagaaaagtaaacacagaaacagagagagagagagaatataaattaagattgttgttgctttacacgtatacataggtatgctgaaggtgtgaacagtatagatagcatatgcaagtacttttagactaaatgccttatgcatctgaggagatacaccgtaggattgtgttattttatttatttatgagtactgagcacagagctttgggttccagccacttctgttatgtagacaagtggcatcaaatcaaggtttggcatcatttctagtgctcatcccattagtcactgtggtcagatgggctgaactaaaataaaatatcctgtttgtggcttcacttacctagaataactggtgacatatatcaagttcacctgataattgttaactctcaatttcagatttcctaaggatctattctttgttaatttaaaagctaatgggaactcaaatgaattttaataacttactttgtacaaaactgcccttaatctaatttggaattttattttgttttatttatttatttatttatttatttaatgtctttttagtttctactggttgataggattgtgttttaaaagggaaaatcgaggaagggaaattgtgttgtttatcttataggaaatgatggttttttttaatttttaaaaattattttaacctgttgttcttatgtctacaaggggaaaataaagtagggctctgaggcatttgaatattttagaccaaataattgctattgagaataaagattcaagcttctcattaatccataattgacatttccactgactgtaggacccagaaccaggagagaattactcaaccctccacttcagtttacttttgtagacactgcctaaatagaaatagaaattctggtgatttcaataacatcaaaaatgacaaattacctgtttaacttaaaaaggtcatgaatgaggccttcagagaaataatattaataatataatgaataaccatagagcagtgcctttaaattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagttgatatggaatcactttaatgctgttttcacaaataaaagttttttcttataggtc

SEQ ID NO: 28264 - DNA, 4444 bp, Homo sapiens
cccggaacccgcggtcgccaccgcggcggcggccccaggctggaggcgtccgggcgcctctttcctccagcctctgggactgcgctgctcgcagtctcctcgccctgcctgggcttgagaaacctagtgcataccccaaagagggtttttgtgtatgtgtgtgtttttaaagggtggctatgatgactgggccttggagatgtgagactgggaggtaaaatgcacacttgctgccccccagtaactttggaacaggaccttcacagaaaaatgcatagctggatgctgcagactctagcgtttgctgtaacatctctcgtcctttcgtgtgcagaaaccatcgattattatggggaaatctgtgacaatgcatgtccttgtgaggaaaaggacggcattttaactgtgagctgtgaaaaccgggggatcatcagtctctctgaaattagccctccccgtttcccaatctaccacctcttgttgtccggaaaccttttgaaccgtctctatcccaatgagtttgtcaattacactggggcttcaattttgcatctaggtagcaatgttatccaggacattgagaccggggctttccatgggctacggggtttgaggagattgcatctaaacaataataaactggaacttctgcgagatgataccttccttggcttggagaacctggagtacctacaggtcgattacaactacatcagcgtcattgaacccaatgcttttgggaaactgcatttgttgcaggtgcttatcctcaatgacaatcttttgtccagtttacccaacaatcttttccgttttgtgcccttaacgcacttggacctccgggggaaccggctgaaacttctgccctacgtggggctcttgcagcacatggataaagttgtggagctacagctggaggaaaacccttggaattgttcttgtgagctgatctctctaaaggattggttggacagcatctcctattcagccctggtgggggatgtagtttgtgagacccccttccgcttacacggaagggacttggacgaggtatccaagcaggaactttgcccaaggagacttatttctgactacgagatgaggccgcagacgcctttgagcaccacggggtatttacacaccaccccggcgtcagtgaattctgtggccacttcttcctctgctgtttacaaaccccctttgaagccccctaaggggactcgccaacccaacaagcccagggtgcgccccacctctcggcagccctctaaggacttgggctacagcaactatggccccagcatcgcctatcagaccaaatccccggtgcctttggagtgtcccaccgcgtgctcttgcaacctgcagatctctgatctgggcctcaacgtaaactgccaggagcgaaagatcgagagcatcgctgaactgcagcccaagccctacaatcccaagaaaatgtatctgacagagaactacatcgctgtcgtgcgcaggacagacttcctggaggccacggggctggacctcctgcacctggggaataaccgcatctcgatgatccaggaccgcgctttcggggatctcaccaacctgaggcgcctctacctgaatggcaacaggatcgagaggctgagcccggagttattctatggcctgcagagcctgcagtatctcttcctccagtacaatctcatccgcgagattcagtctggaacttttgacccggtcccaaacctccagctgctattcttgaataacaacctcctgcaggccatgccctcaggcgtcttctctggcttgaccctcctcaggctaaacctgaggagtaaccacttcacctccttgccagtgagtggagttttggaccagctgaagtcactcatccaaatcgacctgcatgacaatccttgggattgtacctgtgacattgtgggcatgaagctgtgggtggagcagctcaaagtgggcgtcctagtggacgaggtgatctgtaaggcgcccaaaaaattcgctgagaccgacatgcgctccattaagtcggagctgctgtgccctgactattcagatgtagtagtttccacgcccacaccctcctctatccaggtccctgcgaggaccagcgccgtgactcctgcggtccggttgaatagcaccggggcccccgcgagcttgggcgcaggcggaggggcgtcgtcggtgcccttgtctgtgttaattctcagcctcctgctggttttcatcatgtccgtcttcgtggccgccgggctcttcgtgctggtcatgaagcgcaggaagaagaaccagagcgaccacaccagcaccaacaactccgacgtgagctcctttaacatgcagtacagcgtgtacggcggcggcggcggcacgggcggccacccacacgcgcacgtgcatcaccgcgggcccgcgctgcccaaggtgaagacgcccgcgggccacgtgtatgaatacatcccccacccactgggccacatgtgcaaaaaccccatctaccgctcccgagagggcaactccgtagaggattacaaagacctgcacgagctcaaggtcacctacagcagcaaccaccacctgcagcagcagcagcagccgccgccgccaccgcagcagccacagcagcagcccccgccgcagctgcagctgcagcccggggaggaggagaggcgggaaagccaccacttgcggagccccgcctacagcgtcagcaccatcgagccccgggaggacctgctgtcgccggtgcaggacgccgaccgcttttacaggggcattttagaaccagacaaacactgctccaccacccccgccggcaatagcctcccggaatatcccaaattcccgtgcagccccgctgcttacactttctcccccaactatgacctgagacgcccccatcagtatttgcacccgggggcaggggacagcaggctacgggaaccggtgctctacagccccccgagtgctgtctttgtagaacccaaccggaacgaatatctggagttaaaagcaaaactaaacgttgagccggactacctcgaagtgctggaaaaacagaccacgtttagccagttctaaaagcaaagaaactctcttggagcttttgcatttaaaacaaacaagcaagcagacacacacagtgaacacatttgattaattgtgttgtttcaacgtttagggtgaagtgccttggcacgggatttctcagcttcggtggaagatacgaaaagggtgtgcaatttcctttaaaatttacacgtgggaaacatttgtgtaaactgggcacatcactttctcttcttgcgtgtggggcaggtgtggagaagggctttaaggaggccaatttgctgcgcgggtgacctgtgaaaggtcacagtcatttttgtagtggttggaagtgctaagaatggtggatgatggcagagcatagattctactcttcctcttttgcttcctccccctcccccgcccctgccccacctctctttctccccttttaagccatgggtgggtctaactggcttttgtggagaaattagcacaccccaactttaataggaaatttgttctctttttccgcccctctccttctctcctcccctcccctcccttctcattccttttctttgtttttaaaggatgtgtttgtatgcattctggacatttgaattaaaaaaaaagtattgtgatcctgtaaaggatcaccatagatgtggacaaatcattaaaattacagagctatatgatccataattgattagtcaaaataacttattgatgaaatatacaaatattttattgtagcacctatttttatatgcacatttagcattcctctttccttcactatttagcctatgattttgcagaggtgtcacactgtattaggatctgcatttctaaaactgacgtggtatcaggaaggcattttcaatcattcaaaatgtggagaatttaatggctaaatctttaaaagccaatgcaacccacccaattgaatctgcattttcttttaagaaaacagagctgattgtatcccaatgtattttaaaaaatagggcaattgattgggccattccgagagaattgtttgcaagttttgggttttattagaaaatatttgaaagtatttttattaatgaaccaaaatgacatgttcatttgactactattgtagccgattttcgattgtttaaccaaacccagttgcatttgtacagatccacgtgtactggcacctcagaagaccaaatcatggactgtacaagtctctatacaatgtctttatccctgtgggcagcaagcaatgatgataatgacaaacaggatatctgtaagatggggctactgttgttacagtctcatatgtatcccagcacatgtaattttttaaatagtttctgaataaacacttgataactatgtc

SEQ ID NO: 28265 - DNA, 2433 bp, Homo sapiens
gcgaatttgcatcggaggtgcgtttccccgtcagaatgtcagcctccccaggctcattcaactttattttctcaaatttttggtctcctttgctagcaaggaggagggggaagggagtgggttgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactgaaatttcaagggacttggacgaggtatccaagcaggaactttgcccaaggagacttatttctgactacgagatgaggccgcagacgcctttgagcaccacggggtatttacacaccaccccggcgtcagtgaattctgtggccacttcttcctctgctgtttacaaaccccctttgaagccccctaaggggactcgccaacccaacaagcccagggtgcgccccacctctcggcagccctctaaggacttgggctacagcaactatggccccagcatcgcctatcagaccaaatccccggtgcctttggagtgtcccaccgcgtgctcttgcaacctgcagatctctgatctgggcctcaacgtaaactgccaggagcgaaagatcgagagcatcgctgaactgcagcccaagccctacaatcccaagaaaatgtatctgacagagaactacatcgctgtcgtgcgcaggacagacttcctggaggccacggggctggacctcctgcacctggggaataaccgcatctcgatgatccaggaccgcgctttcggggatctcaccaacctgaggcgcctctacctgaatggcaacaggatcgagaggctgagcccggagttattctatggcctgcagagcctgcagtatctcttcctccagtacaatctcatccgcgagattcagtctggaacttttgacccggtcccaaacctccagctgctattcttgaataacaacctcctgcaggccatgccctcaggcgtcttctctggcttgaccctcctcaggctaaacctgaggagtaaccacttcacctccttgccagtgagtggagttttggaccagctgaagtcactcatccaaatcgacctgcatgacaatccttgggattgtacctgtgacattgtgggcatgaagctgtgggtggagcagctcaaagtgggcgtcctagtggacgaggtgatctgtaaggcgcccaaaaaattcgctgagaccgacatgcgctccattaagtcggagctgctgtgccctgactattcagatgtagtagtttccacgcccacaccctcctctatccaggtccctgcgaggaccagcgccgtgactcctgcggtccggttgaatagcaccggggcccccgcgagcttgggcgcaggcggaggggcgtcgtcggtgcccttgtctgtgttaattctcagcctcctgctggttttcatcatgtccgtcttcgtggccgccgggctcttcgtgctggtcatgaagcgcaggaagaagaaccagagcgaccacaccagcaccaacaactccgacgtgagctcctttaacatgcagtacagcgtgtacggcggcggcggcggcacgggcggccacccacacgcgcacgtgcatcaccgcgggcccgcgctgcccaaggtgaagacgcccgcgggccacgtgtatgaatacatcccccacccactgggccacatgtgcaaaaaccccatctaccgctcccgagagggcaactccgtagaggattacaaagacctgcacgagctcaaggtcacctacagcagcaaccaccacctgcagcagcagcagcagccgccgccgccaccgcagcagccacagcagcagcccccgccgcagctgcagctgcagcccggggaggaggagaggcgggaaagccaccacttgcggagccccgcctacagcgtcagcaccatcgagccccgggaggacctgctgtcgccggtgcaggacgccgaccgcttttacaggggcattttagaaccagacaaacactgctccaccacccccgccggcaatagcctcccggaatatcccaaattcccgtgcagccccgctgcttacactttctcccccaactatgacctgagacgcccccatcagtatttgcacccgggggcaggggacagcaggctacgggaaccggtgctctacagccccccgagtgctgtctttgtagaacccaaccggaacgaatatctggagttaaaagcaaaactaaacgttgagccggactacctcgaagtgctggaaaaacagaccacgtttagccagttctaaaagcaaagaaactctcttggagcttttgcatttaaaacaaac

SEQ ID NO: 28266 - DNA, 4318 bp, Homo sapiens
atatgacactggcagattaaaacgctctgatggggaagggcttaaaggctgagtcaaaagccaagaagtctctttatttacgcctacctcccagcccttggcaatctgactaataacaaactgagctaacaagaaatactagaaaaggaggaaggagaacattgctgtagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacagaatcggatttcatcacatgacaacatgaagctgtggattcatctcttttattcatctctccttgcctgtatatctttacactcccaaactccagtgctctcatccagaggctcttgtgattctctttgcaattgtgaggaaaaagatggcacaatgctaataaattgtgaagcaaaaggtatcaagatggtatctgaaataagtgtgccaccatcacgacctttccaactaagcttattaaataacggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgacttattgcagttaaaaacttggttggagaacatgcctccacagtctataattggtgatgttgtctgcaacagccctccattttttaaaggaagtatactcagtagactaaagaaggaatctatttgccctactccaccagtgtatgaagaacatgaggatccttcaggatcattacatctggcagcaacatcttcaataaatgatagtcgcatgtcaactaagaccacgtccattctaaaactacccaccaaagcaccaggtttgataccttatattacaaagccatccactcaacttccaggaccttactgccctattccttgtaactgcaaagtcctatccccatcaggacttctaatacattgtcaggagcgcaacattgaaagcttatcagatctgagacctcctccgcaaaatcctagaaagctcattctagcgggaaatattattcacagtttaatgaagtctgatctagtggaatatttcactttggaaatgcttcacttgggaaacaatcgtattgaagttcttgaagaaggatcgtttatgaacctaacgagattacaaaaactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttgctaacccagattgaccttgaggataacccctgggactgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgccactgtctgttctaatattgggacttctgattatgttcatcactattgttttctgtgctgcagggatagtggttcttgttcttcaccgcaggagaagatacaaaaagaaacaagtagatgagcaaatgagagacaacagtcctgtgcatcttcagtacagcatgtatggccataaaaccactcatcacactactgaaagaccctctgcctcactctatgaacagcacatggtgagccccatggttcatgtctatagaagtccatcctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagcagcaaacatagatggagagtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaaggattatagtaatatttcatatactgaaaagtgtctcataggagtcctcttgcacatctaaaaaggctgaacatttaagtatcccgaattttcttgaattgctttccctatagattaattacaattggatttcatcatttaaaaaccatacttgtatatgtagttataatatgtaaggaatacattgtttataaccagtatgtacttcaaaaatgtgtattgtcaaacatacctaactttcttgcaataaatgcaaaagaaactggaacttgacaattataaatagtaatagtgaagaaaaaatagaaaggttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaagagagggacaatgtagctttattttacaagaaggcatagttagatttctatgaaatatttattctgtacagttttatatagttttggttcacaaaagtaattattcttgggtgcctttcaagaaaattaaaaatactactcactacaataaaactaaaatgaaaa

SEQ ID NO: 28267 - DNA, 4938 bp, Homo sapiens
cagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtaagggagaaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttg

SEQ ID NO: 28268 - DNA, 5233 bp, Homo sapiens
tgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaac

SEQ ID NO: 28269 - DNA, 4752 bp, Homo sapiens
atgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgatgaggaagaaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaa

SEQ ID NO: 28270 - DNA, 6390 bp, Homo sapiens
cggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatgattttttgtttctatgagttctaaacagccctatacagtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttca

SEQ ID NO: 28271 - DNA, 4419 bp, Homo sapiens
atggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagtcttcagagcacaagtatttcaaagcagcctacctgggaactgctcatggtcctgctggccacctagaccaccaatgccctga

SEQ ID NO: 28272 - DNA, 9706 bp, Homo sapiens
gagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactca

SEQ ID NO: 28273 - DNA, 8943 bp, Homo sapiens
cgggacccttgagcgccggagccgacagctggaggcaggaagggagggttgtggcgcccgagctgggcgcgttcccagcgcctgccctccgccgctggccctgtcccgggcgcccggtgcgggtctcgaacaatggtgcggagcgccggcgcgagccccgcgcccgcccagcggccgtagaggaagtggccgggctcccggcgaggtgggcagggagacgtcccccgccactcgctggctggagtttgcctgcgcgtccggcctctcccccggggatcccctgggattaccgacggagctcaatttcgagagtatggtgccagcgcccgggctaatctagtcctctctactcgctctttttcccctcctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggc

SEQ ID NO: 28274 - DNA, 8406 bp, Homo sapiens
gttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggc

SEQ ID NO: 28275 - DNA, 5967 bp, Homo sapiens
gaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctctgtttccattacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcga

SEQ ID NO: 28276 - DNA, 5814 bp, Homo sapiens
cagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctctgtttccattacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcgatgctgca

SEQ ID NO: 28277 - DNA, 2484 bp, Homo sapiens
aggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgattgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacct

SEQ ID NO: 28278 - DNA, 2419 bp, Homo sapiens
gagtaaagaagtcggccagcagctccaagatgatttgatgaaggtcctgaacgagctctactcggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaacaacttacatcttgacaacacaaagcccgtgaccaccaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccat

SEQ ID NO: 28279 - DNA, 690 bp, Homo sapiens
ccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaacaacttacatcttgacaacacaaagcccgtgaccaccaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatc

SEQ ID NO: 28280 - DNA, 2486 bp, Homo sapiens
gtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactata

SEQ ID NO: 28281 - DNA, 8415 bp, Homo sapiens
ctgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaatatgaagcccaaataaaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctc

SEQ ID NO: 28282 - DNA, 8656 bp, Homo sapiens
gtgtgtgtgtatgcctgtgtgcacagcacaactgtgtgcgtgtcccggtgagtgtgcctgtgcatgcgtgagtgtgtgtacgtgtgcatgtgtgtgtgagtgcgcttggttattactattattattatttttggaagaaaaatctttgaaaatctggggcaggttactgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaatatgaagcccaaataaaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccaggcccccctgtcttccccctaaaccacagaaaatgaggagacctaggcctctctcagtgtatagccataaactctttaacggcagtatggaagcattcattaaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaa

SEQ ID NO: 28283 - DNA, 3929 bp, Homo sapiens
gggccccagtgcccccgtccccaccaccagtctcatgctcctacccttgtgtgcccgcagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaggggcctgatgatgttttccccatttgccatccaagactctgatgaggcttaaacgtacgtgtgtgaaaactgtcaagtgctctgtggatacaagtcgagtgactcttaatggccaataggccaggtcctgggagcctaggaccatggaaaaggagagaggacaccacaacctcccaccagcccagtcgttccagaaacccatcaagaaatttaaagagtatgtgaatggcagtaacctcatcaccaagctgcaggccaagcacgatttactcaagcagaccctgggcgaaggggaaagagcagaatgcggcaccaccaggcccccctgtcttccccctaaaccacagaaaatgaggagacctaggcctctctcagtgtatagccataaactctttaacggcagtatggaagcattcattaagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaaaagttgccccatacccagtttcatttggggtgtttctcacagtactctgagagatatttgcagccaggaaagtgtcccaggagatggcaagagaagagaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagctcctcgggctgatgggcagaaggcttctctggacaccaggactgaagatgaggagggacagagagaatagggcttgctgggtcagcgaagaagcagccatgggactcacccagtggggcttcctccccataagaaccaccccccagaaagtgctgcctcccacttctcagggtaaaggttcacagtggcccccagaatgcatgagtcagagctttgggtccccctccgagatgatccttcttctttttgttctttgtaaggctgctggtttctgggaatgacaaaggcaggaaaaatcattctgggaaggaagaagccacagtctgggagagccagtttcatgttccctgaaggctctcaaagtatcctgtgtgtattagtggggggtattgaatcaggggcactctttggtggaaaatcaattgcattttctaaatgttacattcttgccatccctggccaaacagtggcagaatagtgagctgcagagacagtcaaggggtcactgtgctcagaaaaaagagacctggagttgaagcacagagggagtccttatggtcatgtaatctgaggcaagccacatcacctctggcctctatttccttatctataaaatgggaatgacagcaccaagcaaattatggcatgggttaaaatgaggtgacatatgtgaaggagcctagcacagtgcctgggacagggaggtggataagaaacatcaatggactctgtatcaaacagacatccttcctaatcctgatagaaaaactgagtcctggagaattttcttgacctaactggcattggcagttactggtcattggcaaccagaacctcctgatttgtttacctgtttcctcttagacatttcatttaggggatcatcaatatctgtcttctttgctcttgacagcacccggtatgaatggaatccagcaggcctcaaaggtcaaatcaggcagagaaccatgagtccaggtctttgccatgcatgaatcagccaatgaatgccaaattgcaggaacaatttagttgtttgtgtatctgttgcctttcttgtctcaaagattctgtaccaactgggcgtggtggctcacacctgtaaccccaacactttgggaagttgaggtgggcagatcacttgagcccaggaattcgagaccagcctgggcaacatggtgaaactccgtctctacaaaaaaaaccaaaatacaaaaattagccaggcatggtggcatatgcctgtggtcccagcaactcaggaggctgaagtgggagaattacttaagcccagggaggttgaggctgcagtgagccatgattgtgccactgtactccagcctgagtgacagaacaaggtcctgtctc

SEQ ID NO: 28284 - DNA, 479 bp, Homo sapiens
gaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgactttttactgttgagaactgcctgttcccttccacccttgcccctccactaccgtaccagtatgactgagacatatggagtcttgctctgtcgcccaggctggagtgcattggcacgatctcggctcactgcagcctccgcctcctgggttcaagcaattctcctgcctcagcctcccaagtag

SEQ ID NO: 28285 - DNA, 916 bp, Homo sapiens
tgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgca

SEQ ID NO: 28286 - DNA, 2383 bp, Homo sapiens
actgtctctagcagtgggtgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgcagaccctcccaggctcccatccccagcaaggccctcaccaagcatgctggtctttaccctctcaccccacccacctcctgcactgtgaggctgtgggtgagttacagctgagtgctctcgtgcccaggttcccacaccacatctcgcgagtttgcaagggcagggagtaccttttgttctcgtgaaccctccccacctagacaccctgcaaaccccagtgcctttatatgatgtaggccaaattgaccatagagatttgagttttcacctaggttttctccccgtgcttgcaagttgtactgtaacaatggacaaaggacaaaagttaccttctgatttacacctagaagcatcattttgcaataggtgtgttgggggtgctacaggaaaaatacatttcccccaggacaaatcatggggaacaggaaagaaaaggggcatgtaacaatggcatatacaagatgagagttcagggggcttaatatcccctgtccatcattttcatcagtacttactcgagttctaggaaaacagcctcaagccccttccttccagatcactgtccctgggcatctgggaggaggcagaaggtccactgtgatgtgctgcagccaatgagatgggccagggacatgggcagatgtcttgttaaacaagtgtcctaatggggtcaacaaggcccgagtcagctttataggctcttagacctcatcaattccttctagctgatcgccagagccctaggacttgactcattctaactatactcacaagatgctggtttctaagtgacctctgggaaatctggcaaatgaacagccttgcagagagagcactgtgaacctggaaaggcctgagagtgactcagatttccctcaagagatgggaaaatgtgttcctcccattttcaagctttctccctcaatcaacgctggagcactggggacctgggcttcctccctggttctctctttccagactctatgaaggcttccaccttgctattaatacctccttgggaggccaaggtgggcggatcacctgaggtcgggagttcgagaccagcctgaccaacatggagaaaccccatttctactaaaaatacaaaattagtcaggcatggtcgcgcatgcctgtaatcccagctacttgggaggctgaggcagaagaatcgcttgaaactgggaggcggaggttgcggtgagccgagaacatgccattgcactccagcctggacaacaagagtgaaactccatctaaaaataaataaataaataaataaataaaccctccttatgttaggccagtagttatctaactatggccttatgggactctggtatcccaccagccaaagagaggactcttcccaaattatagaacaaaaataagccaaaggattggagtgtttcaaacacatgctttcgtcttataaatgttctgtaaaccc

SEQ ID NO: 28287 - DNA, 1966 bp, Homo sapiens
gggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaac

SEQ ID NO: 28288 - DNA, 1658 bp, Homo sapiens
cactgcatgtgtattcgtgagttcgcggttgaacaactgttcctttactctgctccctgtctttgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcct

SEQ ID NO: 28289 - DNA, 573 bp, Homo sapiens
attgtgtcccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccag

SEQ ID NO: 28290 - DNA, 421 bp, Homo sapiens
gagtcgattgcctcactgcatgtgtattcgtgagttcgcggttgaacaactgttcctttactctgctccctgtctttgatcttggccccctcaagtcctgagtgccttggttcctctttgatgcctttaaaaagctgggcttttgtttgtttgttttctggcttgtttgtttggaaggaggttggtctgatacgtgctactccagtttagccagggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttaca

SEQ ID NO: 28291 - DNA, 558 bp, Homo sapiens
caattctgggtacgtacaacttctggggcctgcaaattattggagagtgagtgaggggcaacgaaagatagacataaaagggcgcgtctcgaaaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccga

SEQ ID NO: 28292 - DNA, 847 bp, Homo sapiens
ggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccgcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctg

SEQ ID NO: 28293 - DNA, 616 bp, Homo sapiens
attatttggagcaacaaggttacctactcgaatcactggatcctgagttgacacaaaacgcatctgttgactcagggtttgtataaccacgtgcagtatttactaggctatccaattctgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactgg

SEQ ID NO: 28294 - DNA, 569 bp, Homo sapiens
aatttggagaggatccctggtcgcgcggcagcggcggcggcgcgcgggtgagcgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttt

SEQ ID NO: 28295 - DNA, 2085 bp, Homo sapiens
atgtgtattcgtgagttcgcggttgaacaactgttcctttactctgctccctgtctttgttagtgtttctcggggttgtttctgtaggaaggtgggggtggtgggcgtgagagacagatgtgggcttgtttttctagttgctgaaactgtatgaaggctttaaagggagaacgttttcttgatgtgctttaggaggggaggaggaacaaatgcctgccagatctcacagctacagtagctgagcttttgtttattttgaagagcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaac

SEQ ID NO: 28296 - DNA, 8769 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaact

SEQ ID NO: 28297 - DNA, 8365 bp, Homo sapiens
ggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaatca

SEQ ID NO: 28298 - DNA, 1207 bp, Homo sapiens
gtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgaaaacaactggtatttctcacagctccttctagatttggacaaaggaatgatacaagagcaggcaatacatggtccataaatcaaaatactataaaaaggtatacagtgaaaagaagtgctcccacccctgcccccattcccccctacctcagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactg

SEQ ID NO: 28299 - DNA, 3199 bp, Homo sapiens
caacaacacggccctggtcgtcgtcgccgctgcggtaacggagcggtttgggtggcggagcctgcgttcgcgccttcccactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaac

SEQ ID NO: 28300 - DNA, 548 bp, Homo sapiens
agtagccaaaacagatttttggttgcagaactcgggcgaggatacttggggtatttggacgtttgccggcttcccaacagaatgttccggttctggtggtgatggcattggagaatggggcttaggcaagcctgtaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacag

SEQ ID NO: 28301 - DNA, 669 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgagacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactat

SEQ ID NO: 28302 - DNA, 854 bp, Homo sapiens
tgataggactgcggtgctcggccgggcagcctgggctgctgcactgcgaagctgtccaatggcttgatgaatccgtgccgccgtcgctttgtgtttcaaagataaggatccgcgcttatcggtgggaattacactctgggcagttgtgaccggctactgcaatcagctggtagttagacctggtttctgccacttgccatgtcagttttcaccactgcaaggatttcttctacttcatgtaaacttctctgtgctgcaaagagaatgccaaagcagcgtctttttgccttcaccatattcagccgctggccgggtcctatacttcaatatcagggctcaaattaatattccagtctcttcccctccccttttcccctctcctcctttcagctgctgttactacgtggagtttggagcctaagctttgaaaactcccatgtggcgcgcccgtcttaagtctgagcatgctcagtagccaaaacagatttttggttgcagaactcgggcgaggatacttggggtatttggacgtttgccggcttcccaacagaatgttccggttctggtggtgatggcattggagaatggggcttaggcaagcctgtagaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatg

SEQ ID NO: 28303 - DNA, 847 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctaaatgggatctcactatgttgctcagactggacgtgattgaactcctgggctcaagtgagtctcccgaataactgggattacaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccag

SEQ ID NO: 28304 - DNA, 368 bp, Homo sapiens
tgataggactgcggtgctcggccgggcagcctgggctgctgcactgcgaagctgtccaatggcttgatgaatccgtgccgccgtcgctttgtgtttcaaagataaggatccgcgcttatcgaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatg

SEQ ID NO: 28305 - DNA, 7009 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgc

SEQ ID NO: 28306 - DNA, 6934 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgagacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgc

SEQ ID NO: 28307 - DNA, 2883 bp, Homo sapiens
ggagcgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaa

SEQ ID NO: 28308 - DNA, 1283 bp, Homo sapiens
aaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaaaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagtttttttt

SEQ ID NO: 28309 - DNA, 1940 bp, Homo sapiens
cgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagcagcagatgctgggataggaagccgagggaaccgtggtttggagtcctctgtcccctgcagttag

SEQ ID NO: 28310 - DNA, 5447 bp, Homo sapiens
agtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 28311 - DNA, 5592 bp, Homo sapiens
cgcactaatacgggcgatgaggcttcgcggctccagtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 28312 - DNA, 5389 bp, Homo sapiens
gcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 28313 - DNA, 2471 bp, Homo sapiens
gttaaactcgtcatttcctccagctagaggagctcaactgatctgttttctttcgcccagccaaaatcacagaatgaaggcggtgaagagcgaacgggagcgagggagccggcgaagacaccgggacggggacgtggtgctgccggcgggggtggtggtgaagcaggagcgtctcagcccagaagtcgcacctcccgcccaccgccgtccggaccactccggtggtagcccgtctccgccgaccagcgagccggcccgctcgggccaccgcgggaaccgagcccgaggagttagccggtccccacccaaaaagaaaaacaaggcctcagggagaagaagcaagtctcctcgcagtaagagaaaccgaagtcctcaccactcaacagtcaaagtgaagcaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaactttttctgtggcaccttggccacatgcctgcaggcatttgttttcagaacagtctcaccaattacaacacaccgtgttttagtagaagtgttgtggttttagttggtgctttcagaactgctgcctaggaaactataaacccttggttaaggggaaatcatggcttgttctctttgtacagttactttatttatataggtgttaagctttgtggaccaggtgtttttcttttggggcgaacccctgagcagagaatcttactaggctttggttatcaccaaaacaacctccagtatataccaaagctttgacttgtttgagctcttgagcttagaagttgattttgcacttatttttttggggggtgggaatgtactgcagtcagtaaacattattgactgtttaacttaaacagatgctttatggcacctgctcaagcccgtgactgtacagaaggatcctggttgctaccagtgggtgctgattcagcatcacaagtgactgaaattggctgtggatctgttctttgtgaaagaattcctgatttctccatggagcatgtacacaacaattttgatcatattaactgtacttcagttttgcatttttattcaaatgttatctctttttttctttgagaaataaactgtcactgatgtgacagcgttctttctttattctaataacatgtatagatctaaagcaggttgtgttgtttacatgtttctacacatttcatcctttaaaaagttgttgagagaggttgtatttaccttcccaaggttggaaagcaggggaatttcccagtgtcctagttttccaccagaggaatatgtgtaagtagcaaagtatttgctgcttacatatagtgtgtatgtatgtatatatgtaaattgtgtgttaaagagctgatactgattttcatatgacaatgttaggcaaaggcctccctgcatttgaagagcaggttttcatttatatgtatttttgggataaaaaaataaaatttgtaaatata

SEQ ID NO: 28314 - DNA, 1412 bp, Homo sapiens
gagttaaactcgtcatttcctccagctagaggagctcaactgatctgttttctttcgcccagccaaaatcacagaatgaaggcggtgaagagcgaacgggagggggtggtggtgaagcaggagcgtctcagcccagaagtcgcacctcccgcccaccgccgtccggaccactccggtggtagcccgtctccgccgaccagcgagccggcccgctcgggccaccgcgggaaccgagcccgaggagttagccggtccccacccaaaaagaaaaacaaggcctcagggagaagaagcaagtctcctcgcagtaagagaaaccgaagtcctcaccactcaacagtcaaagtgaagcaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaacttttt

SEQ ID NO: 28315 - DNA, 5737 bp, Homo sapiens
ggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagtccctcggggaccattcctgggggagatgcagcttttctatacgaattccttctacaaggccatacatctgagcccagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 28316 - DNA, 5581 bp, Homo sapiens
cggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgactttaca

SEQ ID NO: 28317 - DNA, 2403 bp, Homo sapiens
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatag

SEQ ID NO: 28318 - DNA, 1001 bp, Homo sapiens
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgtttggagaaagattgagaaggaaaagagtgaaaggcagttagttgaagtggaagagttgaccttcatgtactgctttccaaaaaattga

SEQ ID NO: 28319 - DNA, 2491 bp, Homo sapiens
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaatgacaaggtggttaaaatgtcctttagtagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatag

SEQ ID NO: 28320 - DNA, 3333 bp, Homo sapiens
agtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaaagagactttaaaa

SEQ ID NO: 28321 - DNA, 1310 bp, Homo sapiens
gagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcatgaagatataatactggaaacaacagctgtaataactttactgcttaataagtgtttgccctatgccaagccctgaccatggcattttatgtaagatgagtccagacaacttcaagaatttaaagaagactaacgttggctttatcatcttgacttttccatttctcaactttgcaaggataaaattggccactgttcttctaatacatgtggaatcctatatgatgtgcccagggacagcatatatagtggaaaagaacatagatgttggaatcacaagtgcttaatctttccaagttgctgtttcttcatctatgatatggaactaataatatgcacattcgtggggtgtgggaggaattaaaggacccaaagtatgtacagcatatatagtataggatgtctggctcagtgtgggtacttgcatagatgttaatttcttataccaaaaaccccaaatgaacctgaattgaatttaaagtgtggtgatgcattgatagtggtggtggtgatgtaggaattaagaattgtcatttacttttctttctagaattagtttggatgagttttgttcagtgagaaaatttcctgaaagaggtagacttctttaagagaaagaaaagtagtttacagaatgtagttgcagaaataatgtgaaagagagcacagattgaggagtaggaaaattaaatttagagtcccagctttgtggagtggcgtgaataaagggaagtgtacatatcactgaattcatgcttttccttaagttatctgttttcagagcagtggaatttttcatcagagataaatatgaaaagaagaaatactacgataaaaatgccatagctattacaaatgtaagtaaa

SEQ ID NO: 28322 - DNA, 419 bp, Homo sapiens
gaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgtttggagaaagattgagaaggaaaagagtgaaaggcagttagttgaagtggaagagttgaccttcatgtactgctttccaaaaaattgatcctagttgttattgaataaattgttgtctgttttaagaatta

SEQ ID NO: 28323 - DNA, 578 bp, Homo sapiens
ttaaaggacccaaagtatgtacagcatatatagtataggatgtctggctcagtgtgggtacttgcatagatgttaatttcttataccaaaaaccccaaatgaacctgaattgaatttaaagtgtggtgatgcattgatagtggtggtggtgatgtaggaattaagaattgtcatttacttttctttctagaattagtttggatgagttttgttcagtgagaaaatttcctgaaagaggtagacttctttaagagaaagaaaagtagtttacagaatgtagttgcagaaataatgtgaaagagagcacagattgaggagtaggaaaattaaatttagagtcccagctttgtggagtggcgtgaataaagggaagtgtacatatcactgaattcatgcttttccttaagttatctgttttcagagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggag

SEQ ID NO: 28324 - DNA, 2473 bp, Homo sapiens
gaggaggaggaggagggaagtgagatggcggaaaggaaaactgcttaaatgatttttaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 28325 - DNA, 2939 bp, Homo sapiens
ggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 28326 - DNA, 742 bp, Homo sapiens
gattccagttcattcctagctcagaaagcaacgttttgagccacaactgtcacaactccagatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaag

SEQ ID NO: 28327 - DNA, 1402 bp, Homo sapiens
gtattcttccttttcagtgaatcagagaatggagggatataatgagtggaactgagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttccc

SEQ ID NO: 28328 - DNA, 703 bp, Homo sapiens
gcgcagtgacgcgccggccatgccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatca

SEQ ID NO: 28329 - DNA, 1889 bp, Homo sapiens
ccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 28330 - DNA, 663 bp, Homo sapiens
gtcgcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatca

SEQ ID NO: 28331 - DNA, 328 bp, Homo sapiens
agtgacgcgccggccatgccggcggctgttgtcgggcctccagcgggcggggccgttggcggagcagaggggaggcgcagccgggcggagggcccacgagggctcagccttcccggtcagcggtggtgacggtatcccagagtgccagagaaccgttgcttttccgagttgctcttcttccaggctccgttggtggtcggcatggcccagcatgactgtttgactttgtaggtggaaatcaacgagaacttgcccgccagaaaaacatgaagaaaacccaggaaattagcaagggaaagaggaaagaggatagcttgactgcctctca

SEQ ID NO: 28332 - DNA, 846 bp, Homo sapiens
atccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttt

SEQ ID NO: 28333 - DNA, 532 bp, Homo sapiens
gcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggagacttaccttcaatctgttcagtctccatccacccctctccgcctctgcatggggataaaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatg

SEQ ID NO: 28334 - DNA, 4863 bp, Homo sapiens
ggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacatcactattaactaccaccacctagcggccagccgcgcggcctcggtggacgatgatgaggaagaggaggataaactgcacgcgatgctctcaatgatctgctcgcggaacctcacagctcccaatccgatgaaagacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacatggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtc

SEQ ID NO: 28335 - DNA, 4728 bp, Homo sapiens
ggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaggctggctgcctgtgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcggggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacatggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtc

SEQ ID NO: 28336 - DNA, 2315 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctct

SEQ ID NO: 28337 - DNA, 938 bp, Homo sapiens
aacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtgaa

SEQ ID NO: 28338 - DNA, 7165 bp, Homo sapiens
cgggagcagagatctgcggccgtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccaagcgaagaaagcgtgatgaggaccggcatgacatcaacaagatgaagggttatactctgctgtcggagggcattgatgagatggtgggcatcatctacaagcccaaaactaaagagactcgggagacctatgaggtgctactcagcttcatccaggctgctcttggggaccagccacgtgatatcctttgtggggcagctgatgaagttctagctgttctaaagaatgaaaagctgcgggacaaggaaaggcgaaaggagattgacctgctgctgggtcaaacagatgataccagataccatgtgctagtgaacctgggcaaaaagatcacagactatggtggagataaggaaatccaaaatatggatgacaacattgatgagacatacggtgtgaatgtgcagtttgagtctgatgaggaggaaggtgatgaagacgtatacggggaggttcgagaagaggcatctgatgatgacatggaaggggacgaggctgtcgtgcgctgcaccctctcggctaatctcgtagcctcaggtgaactgatgagttccaagaagaaggatttgcaccctcgggatattgatgcattttggctgcagcggcagctcagtcgtttctatgatgatgccatcgtgtcgcagaagaaggcagatgaagtattggagattttgaagacggccagtgatgatcgggaatgtgaaaatcagctggttctgctgcttggtttcaacacctttgatttcattaaagtgttgcggcagcacaggatgatgattttatactgtaccttgctggccagtgcacaaagtgaagctgaaaaggaaaggattatgggaaagatggaagctgacccagagctatccaagttcctctaccagcttcatgaaaccgagaaggaggatctgatccgagaggaaaggtcccggagagagcgagtgcgtcagtctcgaatggacacagatctggaaaccatggatctcgaccagggtggagaggcactggctccacggcaggttctggacttggaggacctggtttttacccaagggagccactttatggccaataaacgctgtcagcttcctgatggatccttccgtcgccagcgtaagggctatgaagaggtgcatgtgcctgctctgaagcccaagccctttggctcagaagaacaactgcttccagtggaaaagctgccaaagtatgcccaggctgggtttgagggcttcaaaacactgaatcggatccagagtaagctctaccgtgctgcccttgagacggatgagaatctgctgctgtgtgctcctactggtgctgggaagaccaacgtggccctgatgtgcatgctccgagagattgggaaacacataaacatggacggcaccatcaatgtggatgacttcaagattatctacattgcccccatgcgctccttggtgcaggagatggtgggcagctttggaaagcgcctggccacttatggcatcactgttgctgaactgactggggaccaccagctgtgcaaagaagagatcagtgccactcagatcatcgtctgcacccccgagaagtgggacatcatcacccgcaagggtggtgagcgcacctacacccagctggtgcggctcatcattctggatgagattcatcttctccacgatgacagaggtcctgtcttagaagctttagtggccagggccatccgaaacattgagatgacccaagaggatgtccgactcattggtctcagtgccaccctacccaactatgaagatgtagccacctttctacgtgttgaccctgccaagggtctcttttactttgacaacagcttccgtccagtgcctctggaacagacatatgtgggtatcacagagaaaaaagctatcaagcgtttccagatcatgaatgaaatcgtctatgaaaaaatcatggaacatgctggaaaaaatcaggtgctggtgtttgtccactcccggaaggagactggaaagacagccagggccatccgggacatgtgcctagaaaaggacactctgggtctgtttctgagggagggctcagcctccacagaagtcctgcgaacagaagctgagcagtgcaagaacctagagctgaaggatcttctgccttatggctttgctattcatcacgcaggcatgaccagggttgaccgaacactcgtggaggatctttttgctgataaacatattcaggttttagtttccacagcaactctagcttggggtgtgaatctccctgcacatacagtcatcatcaaaggcacccaggtgtacagtccagagaaggggcgttggacagaactgggagcactggacattctgcagatgctgggacgtgccggaagaccccagtatgacaccaagggtgaaggcatactcatcacatctcatggggagctacagtactacctgtccctcctcaatcaacaacttcctattgaaagccagatggtttcaaagcttcctgacatgctcaatgcagaaatcgtgctaggaaatgtccagaatgccaaggatgcggtgaactggctgggctatgcctacctctatatccgaatgctgcgatccccaaccctctatggcatctctcatgatgacctcaagggagatcccctgctggaccagcgccgactagatctggttcatacagctgccctgatgctggacaagaacaatctggtcaagtacgacaagaagacgggcaacttccaggtgacagaactgggccgtatagccagccactactacatcaccaatgatacagtgcagacttacaaccagctgctgaagcccaccctgagtgagattgagcttttcagggtcttctcattgtcctctgagttcaagaacatcacagtgagagaggaggagaagctggagctgcagaagttgctggagagggtgcctatccctgtaaaggagagcattgaggaacccagtgctaagatcaacgttcttctgcaagccttcatctcacagctgaaattggagggctttgcactgatggctgacatggtgtatgtcacacagtcggctggccggttgatgcgagcgatatttgaaattgtcctgaaccgaggttgggcacagcttacagacaagaccctgaacctctgcaagatgatcgacaaacgcatgtggcagtccatgtgtcctctgcgccagttccggaaactccctgaggaagtagtgaagaagattgagaagaagaatttcccctttgagcgtctgtacgacctgaatcataatgagattggggagcttatccgcatgccaaagatggggaagaccatccacaaatatgtccatctgtttcccaagttggagttgtcagtgcacctgcagcctatcacacgctccaccctgaaggtggagctgaccatcacgccagacttccagtgggatgaaaaggtgcatggttcatccgaggctttttggattctggtggaggatgtggacagcgaggtgattctgcaccatgagtattttctcctcaaggccaagtacgcccaggacgagcacctcattacattcttcgtgcctgtctttgaaccgctgccccctcagtacttcatccgagtggtgtctgaccgctggctctcttgtgagacccagctgcctgtctccttccggcacctgatcttgccggagaagtacccccctccaaccgaacttttggacctgcagcccttgcccgtgtctgctctgagaaacagtgcctttgagagtctttaccaagataaatttcctttcttcaatcccatccagacccaggtgtttaacactgtatacaacagtgacgacaacgtgtttgtgggggcccccacgggcagcgggaagactatttgtgcagagtttgccatcctgcgaatgctgctgcagagctcggaggggcgctgtgtgtacatcacccccatggaggccctggcagagcaggtatacatggactggtacgagaagttccaggacaggctcaacaagaaggtggtactcctgacaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatgggcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcgactgtggcctggcctcagtggtacccacacatcagcactaccacaagaaccaacactgagcctcggaagctagatcacaggttaggggtttctctagatgggggttctgaaatttgcagtgtctgctcctgggaggcagcaccagaaagggcactgaaatgtactagctggatgtgacccagtcttaataaacaggttttctaatccaga

SEQ ID NO: 28339 - DNA, 2673 bp, Homo sapiens
cttttccttccccagtgcgtctttcctgcgtcgttccggcgcggcgggagcagagatctgcggccgtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccaagcgaagaaagcgtgatgaggaccggcatgacatcaacaagatgaagggttatactctgctgtcggagggcattgatgagatggtgggcatcatctacaagcccaaaactaaagagactcgggagacctatgaggtgctactcagcttcatccaggctgctcttggggaccagccacgtgatatcctttgtggggcagctgatgaagttctagctgttctaaagaatgaaaagctgcgggacaaggaaaggcgaaaggagattgacctgctgctgggtcaaacagatgataccagataccatgtgctagtgaacctgggcaaaaagatcacagactatggtggagataaggaaatccaaaatatggatgacaacattgatgagacatacggtgtgaatgtgcagtttgagtctgatgaggaggaaggtgatgaagacgtatacggggaggttcgagaagaggcatctgatgatgacatggaaggggacgaggctgtcgtgcgctgcaccctctcggctaatctcgtagcctcaggtgaactgatgagttccaagaagaaggatttgcaccctcgggatattgatgcattttggctgcagcggcagctcagtcgtttctatgatgatgccatcgtgtcgcagaagaaggcagatgaagtattggagattttgaagacggccagtgatgatcgggaatgtgaaaatcagctggttctgctgcttggtttcaacacctttgatttcattaaagtgttgcggcagcacaggatgatgattttatactgtaccttgctggccagtgcacaaagtgaagctgaaaaggaaaggattatgggaaagatggaagctgacccagagctatccaagttcctctaccagcttcatgaaaccgagaaggaggatctgatccgagaggaaaggtcccggagagagcgagtgcgtcagtctcgaatggacacagatctggaaaccatggatctcgaccagggtggagaggcactggctccacggcaggttctggacttggaggacctggtttttacccaagggagccactttatggccaataaacgctgtcagcttcctgatggatccttccgtcgccagcgtaagggctatgaagaggtgcatgtgcctgctctgaagcccaagccctttggctcagaagaacaactgcttccagtggaaaagctgccaaagtatgcccaggctgggtttgagggcttcaaaacactgaatcggatccagagtaagctctaccgtgctgcccttgagacggatgagaatctgctgctgtgtgctcctactggtgctgggaagaccaacgtggccctgatgtgcatgctccgagagattgggaaacacataaacatggacggcaccatcaatgtggatgacttcaagattatctacattgcccccatgcgctccttggtgcaggagatggtgggcagctttggaaagcgtgatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcgactgtggcctggcctcagtggtacccacacatcagcactaccacaagaaccaacactgagcctcggaagctagatcacaggttaggggtttctctagatgggggttctgaaatttgcagtgtctgctcctgggaggcagcaccagaaagggcactgaaatgtactagctggatgtgacccagtcttaataaacaggttttctaatcc

SEQ ID NO: 28340 - DNA, 2637 bp, Homo sapiens
ttgatacttacactgcttctttctgttggtttccagtgtttaacactgtatacaacagtgacgacaacgtgtttgtgggggcccccacgggcagcgggaagactatttgtgcagagtttgccatcctgcgaatgctgctgcagagctcggaggggcgctgtgtgtacatcacccccatggaggccctggcagagcaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatgggcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagtttagggccgggcgcagtggctcacgcctgtaatcccagcactttgggaggccaaggcgggcggatcacgaggtcaggagttcgagaccagcctggccaacatagtgaaaccccgtctctactaaaaatacaaaaattagctgtgcgtggtggtgggcacctgtagtcccagctactcaggaggttgagtcaggagaatggtgtgaacccaggaggcggaggctgcagcgagccgagattgccccactgcacaccagcccagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcag

SEQ ID NO: 28341 - DNA, 2541 bp, Homo sapiens
gtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcg

SEQ ID NO: 28342 - DNA, 5834 bp, Homo sapiens
cagatgaagtattggagattttgaagacggccagtgatgatcgggaatgtgaaaatcagctggttctgctgcttggtttcaacacctttgatttcattaaagtgttgcggcagcacaggatgatgattttatactgtaccttgctggccagtgcacaaagtgaagctgaaaaggaaaggattatgggaaagatggaagctgacccagagctatccaagttcctctaccagcttcatgaaaccgagaaggaggatctgatccgagaggaaaggtcccggagagagcgagtgcgtcagtctcgaatggacacagatctggaaaccatggatctcgaccagggtggagaggcactggctccacggcaggttctggacttggaggacctggtttttacccaagggagccactttatggccaataaacgctgtcagcttcctgatggatccttccgtcgccagcgtaagggctatgaagaggtgcatgtgcctgctctgaagcccaagccctttggctcagaagaacaactgcttccagtggaaaagctgccaaagtatgcccaggctgggtttgagggcttcaaaacactgaatcggatccagagtaagctctaccgtgctgcccttgagacggatgagaatctgctgctgtgtgctcctactggtgctgggaagaccaacgtggccctgatgtgcatgctccgagagattgggaaacacataaacatggacggcaccatcaatgtggatgacttcaagattatctacattgcccccatgcgctccttggtgcaggagatggtgggcagctttggaaagcgcctggccacttatggcatcactgttgctgaactgactggggaccaccagctgtgcaaagaagagatcagtgccactcagatcatcgtctgcacccccgagaagtgggacatcatcacccgcaagggtggtgagcgcacctacacccagctggtgcggctcatcattctggatgagattcatcttctccacgatgacagaggtcctgtcttagaagctttagtggccagggccatccgaaacattgagatgacccaagaggatgtccgactcattggtctcagtgccaccctacccaactatgaagatgtagccacctttctacgtgttgaccctgccaagggtctcttttactttgacaacagcttccgtccagtgcctctggaacagacatatgtgggtatcacagagaaaaaagctatcaagcgtttccagatcatgaatgaaatcgtctatgaaaaaatcatggaacatgctggaaaaaatcaggtgctggtgtttgtccactcccggaaggagactggaaagacagccagggccatccgggacatgtgcctagaaaaggacactctgggtctgtttctgagggagggctcagcctccacagaagtcctgcgaacagaagctgagcagtgcaagaacctagagctgaaggatcttctgccttatggctttgctattcatcacgcaggcatgaccagggttgaccgaacactcgtggaggatctttttgctgataaacatattcaggttttagtttccacagcaactctagcttggggtgtgaatctccctgcacatacagtcatcatcaaaggcacccaggtgtacagtccagagaaggggcgttggacagaactgggagcactggacattctgcagatgctgggacgtgccggaagaccccagtatgacaccaagggtgaaggcatactcatcacatctcatggggagctacagtactacctgtccctcctcaatcaacaacttcctattgaaagccagatggtttcaaagcttcctgacatgctcaatgcagaaatcgtgctaggaaatgtccagaatgccaaggatgcggtgaactggctgggctatgcctacctctatatccgaatgctgcgatccccaaccctctatggcatctctcatgatgacctcaagggagatcccctgctggaccagcgccgactagatctggttcatacagctgccctgatgctggacaagaacaatctggtcaagtacgacaagaagacgggcaacttccaggtgacagaactgggccgtatagccagccactactacatcaccaatgatacagtgcagacttacaaccagctgctgaagcccaccctgagtgagattgagcttttcagggtcttctcattgtcctctgagttcaagaacatcacagtgagagaggaggagaagctggagctgcagaagttgctggagagggtgcctatccctgtaaaggagagcattgaggaacccagtgctaagatcaacgttcttctgcaagccttcatctcacagctgaaattggagggctttgcactgatggctgacatggtgtatgtcacacagtcggctggccggttgatgcgagcgatattgaaattgtcctgaaccgaggttgggcacagcttacagacaagaccctgaacctctgcaagatgatcgacaaacgcatgtggcagtccatgtgtcctctgcgccagttccggaaactccctgaggaagtagtgaagaagattgagaagaagaatttcccctttgagcgtctgtacgacctgaatcataatgagattggggagcttatccgcatgccaaagatggggaagaccatccacaaatatgtccatctgtttcccaagttggagttgtcagtgcacctgcagcctatcacacgctccaccctgaaggtggagctgaccatcacgccagacttccagtgggatgaaaaggtgcatggttcatccgaggctttttggattctggtggaggatgtggacagcgaggtgattctgcaccatgagtattttctcctcaaggccaagtacgcccaggacgagcacctcattacattcttcgtgcctgtctttgaaccgctgccccctcagtacttcatccgagtggtgtctgaccgctggctctcttgtgagacccagctgcctgtctccttccggcacctgatcttgccggagaagtacccccctccaaccgaacttttggacctgcagcccttgcccgtgtctgctctgagaaacagtgcctttgagagtctttaccaagataaatttcctttcttcaatcccatccagacccaggtgtttaacactgtatacaacagtgacgacaacgtgtttgtgggggcccccacgggcagcgggaagactatttgtgcagagtttgccatcctgcgaatgctgctgcagagctcggaggggcgctgtgtgtacatcacccccatggaggccctggcagagcaggtatacatggactggtacgagaagttccaggacaggctcaacaagaaggtggtactcctgacaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatgggcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaacc

SEQ ID NO: 28343 - DNA, 2447 bp, Homo sapiens
agtgacgacaacgtgtttgtgggggcccccacgggcagcgggaagactatttgtgcagagtttgccatcctgcgaatgctgctgcagagctcggaggggcgctgtgtgtacatcacccccatggaggccctggcagagcaggtatacatggactggtacgagaagttccaggacaggctcaacaagaaggtggtactcctgacaggcgagaatgggcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatata

SEQ ID NO: 28344 - DNA, 1595 bp, Homo sapiens
gaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggattttttttttttttttgtaactggcttgtatgatattttctttctgtatttctctatatcattttgtattaaaagccaaatagatgcctttttacaagagccatgtggattggatttattgctgtcttttttttgaggcttgattgctataaatcagaatagagcatgatgtggccacagaatacaattcatttaaacttcc

SEQ ID NO: 28345 - DNA, 1087 bp, Homo sapiens
agggaaattaggaaagggcgatgtaagtttggcttttataagttcattgtcacagtagttcctggtatttagtttgtcacattgaagctttgctggatgtgactaagctggcagagaaatcttgcaaaatatctttttgaaattagtatcacacccaactgcattctgttgcaaattaccaacattgtgtgtgacatttttccttcctgccccctcagctagccccagttattgggatttagatgtgttttcctgcttgaaaaagaaaagagccttaacaggtagcagtatgtcaagttggactttgcccaccgaggaaacagcatctgccattgattgacatgatactaatttcagctgggtgcccaggaggcctctggccgatagttgttttggttggtttgtttatttggatttgttttgcagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggattttttttttttttttgtaactggcttgtatgatattttctttctgtatttctctatatcat

SEQ ID NO: 28346 - DNA, 1483 bp, Homo sapiens
aattgcgtggcgcctgagagcggcagcgcggtcagtggcggcgctgaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcatagagacggggtttcaccgcattggtcagggtggtcacgaactcctgacgtccagtaatccacccgcctcagcctcccaaagtgctgggattacaggtgtgagccactgtgcccagctgcaaacagtctttatgtgggtatcaatgtcagtctcaccattgctcataagtggtgagagtaagagcaatgctccattttcttcttgatctcaaagggaagttgttatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaaca

SEQ ID NO: 28347 - DNA, 1628 bp, Homo sapiens
ggcggggccaggagagaaagctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaatc

SEQ ID NO: 28348 - DNA, 971 bp, Homo sapiens
gagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctg

SEQ ID NO: 28349 - DNA, 1055 bp, Homo sapiens
ggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaa

SEQ ID NO: 28350 - DNA, 842 bp, Homo sapiens
gcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaa

SEQ ID NO: 28351 - DNA, 1054 bp, Homo sapiens
gagtggggccccgaaatctgagggtgatcgtagtcactagttgtggcccccatgcaggagcggagagcgggttctggtttctgaaacctcgagggatgggagagtatctgggccgggtggacggaggcagggagatggagagcgctagacaccccattttagagtgcagatggatcccgcttaaggcaacaaaaaaaagcctggtttatgtgtcgacgctttgatgcttttgagtcgtgaggcggtctggctttttgttttgtttgtttgttttgtttttatcttccatgaacagcgcttccgtggatgggcatctcagtggttgtcgtctttttctcttcctttcacctcttttcaggttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaa

SEQ ID NO: 28352 - DNA, 600 bp, Homo sapiens
caacggcctgcagagcaacatgcccaaccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggg

SEQ ID NO: 28353 - DNA, 355 bp, Homo sapiens
ttctttttttaacgtttccacttttatgattatttcagagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggc

SEQ ID NO: 28354 - DNA, 942 bp, Homo sapiens
gctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgctggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatatgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagag

SEQ ID NO: 28355 - DNA, 1528 bp, Homo sapiens
tggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaa

SEQ ID NO: 28356 - DNA, 1605 bp, Homo sapiens
agctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctgatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 28357 - DNA, 1643 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggagatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 28358 - DNA, 1751 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggagatgtaagtgggatctgtggatctgaaaattcacagtggccagctcaccaccacctgatgaaagatacaccacagggtgagagcatcctaacagcaaactgcaaatgagatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 28359 - DNA, 1904 bp, Homo sapiens
ttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaatt

SEQ ID NO: 28360 - DNA, 4744 bp, Homo sapiens
gccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagacagggagccaggatgggaaccacggactgacctgacctgcgtcctcggggccactgcactgggtgattcacgtgtgcccaggccctgaggtgggccggacctgggagtggcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 28361 - DNA, 2715 bp, Homo sapiens
atggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccagtccacccagcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgt

SEQ ID NO: 28362 - DNA, 620 bp, Homo sapiens
caccagttctaagggaccatacagagtattcctctcttcacaccaggaccagtcactgttgcagcatgagttcccagcagcagaagcagccttgcaccccaccccctcagcttcagcagcagcaggtgaaacagccttgccagcctccacctcaggaaccatgcatccccaaaaccaaggagccctgccaccccaaggtgcctgagccctgccaccccaaagtgcccgagccctgccagcccaaggttccagagccatgccaccccaaggtgcctgagccctgcccttcaatagtcactccagcaccagcccagcagaagaccaagcagaagtaatgtggtccacagccatgcccttgaggagccggccaccagatgctgaatcccctatcccattctgcgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattcca

SEQ ID NO: 28363 - DNA, 222 bp, Homo sapiens
atgagttcccagcagcagaagcagccttgcaccccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgcccttcaatagtcactccagcaccagcccagcagaagaccaagcagaagtaa

SEQ ID NO: 28364 - DNA, 709 bp, Homo sapiens
agagatcctctgctgcacgactcttaaacccctggtacctgagcactgatctgccttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatatatatttgt

SEQ ID NO: 28365 - DNA, 662 bp, Homo sapiens
actcctggtactcgagcaccgatctgctttggagaaactggttaatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagccaaagtatccaccgaagagcaagtaacagcttcaggattcatcaggagcatgagaggataaggataattggctcacctcgttccacagctccaccttcatcttctcatcaaagcttatcatggattcatagggagcttctttccccttagcctgtgatctgcccatgatgttccctgatagcaaaaggtttcctttctaaggctgccatactgccactgtccaggtggagactgagcaaaggaaccttggctttgtcagttcccagagcttcagcagaaagagctgcagctgtgtgcctgggaaccatcagagaattctgttgatgtgttctgtgtctgtctttcacctgggcatgagcttctaccacctgtgcaattgtcacttttctttcactccctgaataaa

SEQ ID NO: 28366 - DNA, 324 bp, Homo sapiens
gcaccgatctgctttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagccaaagtatccaccgaagagcaagtaacagcttcaggattcatcaggagcatgagaggataaggataattggctcacctcgttccaca

SEQ ID NO: 28367 - DNA, 698 bp, Homo sapiens
agaggttctctgctgcccaactcctaaactcctggtactcgagcaccgatctgctttggagaaactgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagccaaagtatccaccgaagagcaagtaacagcttcaggattcatcaggagcatgagaggataaggataattggctcacctcgttccacagctccaccttcatcttctcatcaaagcttatcatggattcatagggagcttctttccccttagcctgtgatctgcccatgatgttccctgatagcaaaaggtttcctttctaaggctgccatactgccactgtccaggtggagactgagcaaaggaaccttggctttgtcagttcccagagcttcagcagaaagagctgcagctgtgtgcctgggaaccatcagagaattctgttgatgtgttctgtgtctgtctttcacctgggcatgagcttctaccacctgtgcaattgtcacttttctttcactccctgaataaagtatctatgcata

SEQ ID NO: 28368 - DNA, 878 bp, Homo sapiens
cctcgaccttctctgcacagcaggtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagcacattgtcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctcttccctcattaaattgcttttaattcca

SEQ ID NO: 28369 - DNA, 985 bp, Homo sapiens
tcaccagatcccagaggctgaacacctcgaccttctctgcacagcagatgatccctgagcagctgaagaccagaaaagccactaagactttctgcttaattcaggagcttagaggattcttcaaagagtgtgtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagcacattgtcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctcttccctcattaaattgcttttaattcc

SEQ ID NO: 28370 - DNA, 622 bp, Homo sapiens
cagatcccagaggctgaacacctcgaccttctctgcacagcagatgatccctgagcagctgaagaccagaaaagccactaagactttctgcttaattcaggagcttagaggattcttcaaagagtgtgtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactcc

SEQ ID NO: 28371 - DNA, 486 bp, Homo sapiens
atgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaa

SEQ ID NO: 28372 - DNA, 16068 bp, Homo sapiens
gccgtgtgagcgtgaggagctgccgccaccgcctgctcctcgtcgtcctcgtcctccggggccccggcgacgtgggccgcgcacggccctggaaaagacgtcgcctccccttcatccgcctctctctcaccgcgccgctcccgcctcctcgtcctgcgctgcgggctcaggcggaacccggaacggccgtcctcttcccccgccctccgccgcctcctccttctcctcctcctcctcctcctcctccttctcggcttcctcctcagccccgggccggagcggggtgtcggcggcggccggttcgggcggcgactcgcgcttctttgggcggcggcgcttggccatgtcgtgtcggggaaggtaatgagccgcagagccccggggtctcggctgagcagcggcggcggcggcggcggcaccaagtatccgcggagctggaatgactggcaacccagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaagacatggaagcatatgctgaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcatgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagcagtggcaacatgaagatctacttatcaatagaccacaagccatgtcagtcacacctcccccacggtctgctatcctaaccagcatgaaaaagaagctgcataccctgagccagattgaaacttctattgcaacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagca

SEQ ID NO: 28373 - DNA, 16115 bp, Homo sapiens
gtgcgacagcggcggcgcggcgggcggagccgggaggcggggaagcagtggccgtgtgagcgtgaggagctgccgccaccgcctgctcctcgtcgtcctcgtcctccggggccccggcgacgtgggccgcgcacggccctggaaaagacgtcgcctccccttcatccgcctctctctcaccgcgccgctcccgcctcctcgtcctgcgctgcgggctcaggcggaacccggaacggccgtcctcttcccccgccctccgccgcctcctccttctcctcctcctcctcctcctcctccttctcggcttcctcctcagccccgggccggagcggggtgtcggcggcggccggttcgggcggcgactcgcgcttctttgggcggcggcgcttggccatgtcgtgtcggggaaggtaatgagccgcagagccccggggtctcggctgagcagcggcggcggcggcggcggcaccaagtatccgcggagctggaatgactggcaacccagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaagacatggaagcatatgctgaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcatgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcaacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagca

SEQ ID NO: 28374 - DNA, 4559 bp, Homo sapiens
gtcgcgggcagccgcctcacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 28375 - DNA, 1762 bp, Homo sapiens
agcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagccc

SEQ ID NO: 28376 - DNA, 670 bp, Homo sapiens
cttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 28377 - DNA, 3985 bp, Homo sapiens
aggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaa

SEQ ID NO: 28378 - DNA, 5788 bp, Homo sapiens
gagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctcc

SEQ ID NO: 28379 - DNA, 5970 bp, Homo sapiens
cccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccaga

SEQ ID NO: 28380 - DNA, 2483 bp, Homo sapiens
gagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctct

SEQ ID NO: 28381 - DNA, 3526 bp, Homo sapiens
ccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactga

SEQ ID NO: 28382 - DNA, 4642 bp, Homo sapiens
agccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaa

SEQ ID NO: 28383 - DNA, 5629 bp, Homo sapiens
cggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacc

SEQ ID NO: 28384 - DNA, 3263 bp, Homo sapiens
tttactaacggaccggaaggactctagagaacgctctgcactatggctggtcccgtgagcttgcgagaccttctaatgggagcatcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatg

SEQ ID NO: 28385 - DNA, 3232 bp, Homo sapiens
agaacgctctgcactatggctggtcccgtgagcttgcgagaccttctaatgggagcatcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatctgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatg

SEQ ID NO: 28386 - DNA, 2353 bp, Homo sapiens
atccacgcacgctcagcccggcgagcgcattcagttctcgagctccagccctcagcgcatgcgcaggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctg

SEQ ID NO: 28387 - DNA, 3288 bp, Homo sapiens
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgccccgcaaggctcctgggcccctccctcaccagcaccacccctgcctcctcctccagcggctcctcctctcggggcccgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 28388 - DNA, 3295 bp, Homo sapiens
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacga

SEQ ID NO: 28389 - DNA, 3130 bp, Homo sapiens
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacga

SEQ ID NO: 28390 - DNA, 1508 bp, Homo sapiens
actcagccagagacagcagcccctgccactgccccaccattaccccccatagagtccccaccagcaccatgccgggggtaccagggcctgggcctgagctggccgcagcccttgaggagcagttgggccgggcactggaggagctgcgggcggtggctgaagcaggccgggtggcagtgacccaggcagccgaggtagctgtagccaccgtggagccggtggcccgggcagctgaagagctgcgggcagagagagccgctcctccaccggcaccacccgcagcactagtctcatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 28391 - DNA, 4951 bp, Homo sapiens
agcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccgtctctctccctcctcctgactggctagaaccaagtatgggggtgatgcttattgcaactgcagctatgtacaggagaggccaagtcactgttcccaaccccacccactggcaaatgaaaaaaccaagacacagagagtttaagggatatgctcttgatcacccagccaggattggactagggctggaaccaactaagggctctggcctgagtttcagggggtcttctcataattcctcaggaatgtggagcctggagggctcttcccccaagactctccctgctctcttcagactaggacaagctggctcatggctgagttgggccagcccacactccctgctgaaaactatctccatcccatccccacccttgccacctggccttcccgctaagcagaaaggaatgacgggggggcgctaaaaagggagatgatagagggttctttggccctacccctgaatgatttggggggtggggacagaggaaatcaccccgcctttactggctcccgtctggttatcagacccacactggaggcttatctctgccactatcttccaggggaaccctgggccagtcctctctcccttgagccacggaggatctgtatgtagcaggtggctctacatggtggaggtgtgggggaggcaacaggattggctgactcactccagagaaggtgttctttcctgaacctggttagaccagtcacccccaatttcccgggaactgaggggttgagaaccggtagaagcagctgtcacccagggatgccctctataaggccctggggtggcccctagtgccagccaccttatatgtctgggggattggtcctcccactctgcaccctggcttcttccatggtggctaggtccaggccagtgcagtggggacaatagccctcagccaggcaggactcctgagcacctgtcctcagtttccccatctgtggatgaagcagtcaacccccagctgggctgtggtgtttggtgactagaccagggagcctcccttgctcagagggtggacttcatctgtcacctttccctctagggaccctgttagtgacccacagggtggcctccctcctcctcctacaatagctccctgacttttggggatctgggctctgagaggcaggaatcgagttgtagaaaggagtgcctggcttggcacctggcacaagtgggcagtttctggctgtccactcacagttgtgtgctctgtgaaccacaatgcaaagtggactacccaagatccctgaaacagtgggctgggtctacccccgggaccctgcgtgggcaggcaggcacgtgaagagcttgggacacagggagtggacacaggccacacattgtgccctaggcagagccgtgggcagctggtgccagccctccgcccctggcagccaaaatgacctgcctctcgcacccactgcagctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaaggctgccgaggatgccgggacccccgtggcccacccacctgccttcagcacccgccgccgctcctccaccggcaccacccgcagcactagtctcatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaac

SEQ ID NO: 28392 - DNA, 566 bp, Homo sapiens
gtaacaacatggcagctcccatgagaacggcatggttggagtcagaagaggaagaagcagaactgggcaggactccagaccccatcctcccaactccacccactttagtctccatggagacccaagggcggctttagggcctctggcactgaagatggaatagctttgccttgtggatctgacctcctgggtaccctggctgattccttgtttggtcttggacatgtcagctctctctgggcctcaatttcccccttttgctgaatgacagcctggactccatattccctatttaggactccagcgctcctaaaggcagactctcagggcttggaaggtagaagcatgctacaagaaggcaatgtctgttcaaagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactg

SEQ ID NO: 28393 - DNA, 3198 bp, Homo sapiens
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 28394 - DNA, 1897 bp, Homo sapiens
atggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacagttgtggaggatgaggctaaggctgaacccaaggagcccgatgggaaagaggaggccaaacatggtgcaaaagaggaggctgatgagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctgtctggcccctcagtgctctctccatacttggcccaggaacctctgcactctgggataataaactctggccataggggattcctcacctgctgaggtctcaataactgcgcaaggtgtttgggaaaggacaatggcctggttcccaccactaaccagctgtgtgacacatacagttaacctctctgggccccagtttacagtctgaaaggggataatgagagttccaaccttatgaaggtgttgcaagagttaaacgagataatgaaatgggcaaaaagctttgcccagtcctgccactcaagtgttcagtaagtggtcgccaaaaataaaaaacttacattttgactctggtggcacttct

SEQ ID NO: 28395 - DNA, 2062 bp, Homo sapiens
atgctcccgggggcagttggagagtcagattgctcagcagaggccagggagaagatggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacaggccagaggaaagagtgcagcactgaacccaaggagaaggctactgatgaagaggccaaggctgaatcgcagaaggctgttgtggaggatgaggctaaggctgaacccaaggagcccgatgggaaagaggaggccaaacatggtgcaaaagaggaggctgatgcaaaagaggaggcggaggatgcagaggaggcagagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctgtctggcccctcagtgctctctccatacttggcccaggaacctctgcactctgggataataaactctggccataggggattcctcacctgctgaggtctcaataactgcgcaaggtgtttgggaaaggacaatggcctggttcccaccactaaccagctgtgtgacacatacagttaacctctctgggccccagtttacagtctgaaaggggataatgagagttccaaccttatgaaggtgttgcaagagttaaacgagataatgaaatgggcaaaaagctttgcccagtcctgccactcaagtgttcagtaagtggtcgccaaaaataaaaaacttacattttgactctggtggcacttct

SEQ ID NO: 28396 - DNA, 1649 bp, Homo sapiens
agatggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacaggccagaggaaagagtgcagcactgaacccaaggagaaggctactgatgaagaggccaaggctgaatcgcagaaggctgttgtggaggatgaggctaaggctgaacccaaggagcccgatgggaaagaggaggccaaacatggtgcaaaagaggaggctgatgcaaaagaggaggcggaggatgcagaggaggcagagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctg

SEQ ID NO: 28397 - DNA, 1807 bp, Homo sapiens
agccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 28398 - DNA, 831 bp, Homo sapiens
ataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttt

SEQ ID NO: 28399 - DNA, 683 bp, Homo sapiens
gaagcagcagctgaggagactccggtgttcaccatggccaacgaaaagcccacagaagaagtcaagactgagaacaacaatcatattaatttgaaggtggcgggacaggatggttctgtggtgcagtttaagattaagaggcagacaccacttagtaaactaatgaaagcctattgtgaaccacggggattgtcagtgaagcagatcagattccgatttggtgggcaaccaatcagtggaacagacaaacctgcacagttggaaatggaagatgaagatacaattgatgtgtttcaacagcctacgggaggtgtctactgaaaagggaacctgcttctttactccagaacgctgttctttaaagaccaagattactgcattctcaattagaaaactgcaatttggttccaccacattctgactactacagtatagttttctctattcttttgtttcccccttccacattcttttattatacatgaagtaactggtatgtgtacacaagcatattgcttttttcttcaaaccaaacagccaatggtatgttttgattgacatcaagtggagacaggatgggaaaaaatactgattctgtgaaaataccccctttatccattagtggcatgttcattcaggtcttatctttatattctagtaagttattttgctctcactgtttt

SEQ ID NO: 28400 - DNA, 1030 bp, Homo sapiens
cgggcgccccctcacggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacgtgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatga

SEQ ID NO: 28401 - DNA, 5183 bp, Homo sapiens
agctacccggcaccccctccccgcggccggcagcccgctcggtattatgattagcgctgggtgcggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgcttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaat

SEQ ID NO: 28402 - DNA, 5128 bp, Homo sapiens
gcagctacccggcaccccctccccgcggccggcagcccgctcggtattatgattagcgctgggtgcggggtttcggcggccgggagggagttgtcggcgccgcggccgctgcggacggacgctcgcctgccggctgagatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgcttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaatataaa

SEQ ID NO: 28403 - DNA, 2961 bp, Homo sapiens
cacagtgacgcgcagcccgcgcaggcgcagctacccggcaccccctccccgcggccggcagcccgctcggtattatgattagcgctgggtgcggggtttcggcggccgggagggagttgtcggcgccgcggccgctgcggacggacgctcgcctgccggctgagagcctcctgagagtctgctttggcatccccagcatttggcctctgctcaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttat

SEQ ID NO: 28404 - DNA, 10474 bp, Homo sapiens
aacttgggcagaggtcaggggtcacgcgaggtcagtccgtcgggagggctagggagatggtcacgaaacctgaagtcaagagttaaggcttgttggcttctggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaaggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccaggtgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagca

SEQ ID NO: 28405 - DNA, 9999 bp, Homo sapiens
aacttgggcagaggtcaggggtcacgcgaggtcagtccgtcgggagggctagggagatggtcacgaaacctgaagtcaagagttaaggcttgttggcttctggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagc

SEQ ID NO: 28406 - DNA, 10287 bp, Homo sapiens
aacttgggcagaggtcaggggtcacgcgaggtcagtccgtcgggagggctagggagatggtcacgaaacctgaagtcaagagttaaggcttgttggcttctggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagc

SEQ ID NO: 28407 - DNA, 714 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggac

SEQ ID NO: 28408 - DNA, 951 bp, Homo sapiens
gggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaa

SEQ ID NO: 28409 - DNA, 2319 bp, Homo sapiens
atttgatgacctccaggcagtggagaggcagtcgaggaagaccagggccccaggcgcctacgtgggtggaatgcacaaggttggccttggctgccggggctccatgtcccagcactagccaaggagggcctcagccgcgcttgaatactcgtgctttcctcgccgcgaggctttgcgaatcttggccactagctaaaggcggggtcgccgggccggtaggaactggagacactcagcctcgcggcaggaaatgcggctcgtggcttccggcgcgtgcagatgacgcgcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagcaagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctgga

SEQ ID NO: 28410 - DNA, 3806 bp, Homo sapiens
gagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacct

SEQ ID NO: 28411 - DNA, 3943 bp, Homo sapiens
gggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctaga

SEQ ID NO: 28412 - DNA, 2967 bp, Homo sapiens
cttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctag

SEQ ID NO: 28413 - DNA, 869 bp, Homo sapiens
ctcttgctacggtggcctggaggagtggcgaaaccggaacagagaatttatcacttctgggactcacagtcgtgatgtctttcaagagggaaggagacgattggagtcaactcaatgtgctcaaagtaagcgtgagcggagaggatctggagccgcttcagtcgctccctgaagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaacttaa

SEQ ID NO: 28414 - DNA, 2016 bp, Homo sapiens
acaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaacttaactttccttaagtctggttccttgttggatctcaggatttcagatctgttcattctcattccaactactccttgcctgcaaggtacacagctctccacactccttttttttttttttttttttttgaggcagagtctcgctctatcgcccaggctggagtgcagtggcacgatctcggctcactgcaagctctgcctcccaggttcacgcctttctcctgcctcagcctcctgagtagctgggactacaggcgcccgccaccatgcccagctaattttttgtatttttagtagagacggggtttcactgtgttagccaggatggtctcgatctcctgacctcgtgatccgcccacctcggcctcccaaagtgctgggattacaggcatgagccaccgcacccagccacggctatccatacttctaacccctcccccacctcctaccaaagccatgccaagcgtcagctgcatcagcctggtgccctattaataagactgtcaaaaagaggtctttgcccttcatgttgtctgcctgcttctccactaccactcaaagtcctttcccccttcaaatcacataaggactgcaggtaggcactagggggacctggccacatctggaaacagggctgtggctaagttccctgtgaaagtagaagagtcaaaaggcattggcagggttatggggaacaccaagggagggaacacccccacctcctcctagtaacctgaacctccctgcctgctgatccccagagtataaataatcccctggtgaactggcagtaacccttgggggttagcgccaagattctcaccccaaagcccaaggaaggaggcaggcaaaatggatagaagggcttttatttacaggaaaggaggacagatgaggatttaagtgtccagtgctcccagcgctagttggtaaagggaaatgcagtgttatctcttcttttgctggcgacctgtaaaggagcaatattaaacataagtgtttgttccagctcctgctttctgcaaaggcactcttctcctttccagtcccttagccaaactcataaattggtagtgtcttaggccaccttacaggcccatcccacattaacaaaacaaaacaagaaaccacaccacaaataaaattacgatacctctaaacaag

SEQ ID NO: 28415 - DNA, 3135 bp, Homo sapiens
ccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 28416 - DNA, 3545 bp, Homo sapiens
aaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccaggtgcggtcgctcacacctgtaatcccagcactttgggaggccgaggcgggcagatcacgagggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaagg

SEQ ID NO: 28417 - DNA, 2556 bp, Homo sapiens
atgctgctgcatataaacccagcttatttatttaaactgctgcatggattcccgccgtggataatgcctaccgatgggaatttaggtgacaaaaattttcagatggggaaaccagggcacagagagggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgagtcca

SEQ ID NO: 28418 - DNA, 2597 bp, Homo sapiens
gtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgagtcca

SEQ ID NO: 28419 - DNA, 2679 bp, Homo sapiens
gacatcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactcc

SEQ ID NO: 28420 - DNA, 3475 bp, Homo sapiens
tataaatgcttctcatcagactcaaggcctgaggtgatgctgatgctgtgcctgaattccagcagggaggaggcatgaggtgcgtccgactcccttcccatcacagctgagctagtttttcaggttaactttggaatgcccatggctaagaccaggggtccatccagacagttcagggcttataattttatttttggtttatgagggaacctagaaggcagcccacacgcaccttactcctcccagcaggggacaccggccagaccccaagctccacactcccaccctcagcacccacccaggccagcagccgggggcaccttggtgccaccttagtgcctgttctgcggaggctccactggacagtgcagttgatgcccggggccgagggggctctgcctgggaggctgttcacctgcctgggtgcaggaccccagagggaccccaggccacccctggcctgcccatgcccacgggaatcccgaccttgggctgcctgtctattgcaccagaaccgtcccagggctgactcagagtgaccctgagtgggggacgctcaccccaggggaggaaacggggctctgggataggaggtcctggctggggtcccacagatgccaggcgcctgccatctccagggcagtgctgtcacagaagacaacaccgctccctcgttacctgtggcccggccacctcagcggcccaaggaggtgagctcacagccatgctcggtcaatggggcctggccgtctttcctgggagagagcagaggcatgggcccaaagggagccagggatgcctgcccgtcccttctctcattcaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactcc

SEQ ID NO: 28421 - DNA, 923 bp, Homo sapiens
tgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagcc

SEQ ID NO: 28422 - DNA, 3365 bp, Homo sapiens
ggaaccgagctgtggcctggggttccatggagcaggtggggcgcggaggaactgagctgtggcctggggttccgtggagcaggttgagtatggaggaactggggttccgtggagcaggtggggcgcagaggaaccgagctgtggaatggggttccgtggagcaggttgagtgtgccggtcgtggacgggtcgtgggcgggactccccagtgtgtcaccactgaggcatcttcgccctcttacgtgtctctgtttctctctctagaagtccaacacctccgagaggactcaaaacacagagtgaccagctcctatgtgcatttcctgggcgacagcgagactccatctcaataaataaaaaaaaaaaagagttgttatcagtagaagggaatgtctggttacagtatggcgttgtgcagatgaaggtcttatcgcagatgaagccaccaggtcacaagcctcagagagaatcaactataaatgcttctcatcagactcaaggcctgaggtgatgctgatgctgtgcctgaattccagcagggaggaggcatgagggcagtgctgtcacagaagacaacaccgctccctcgttacctgtggcccggccacctcagcggcccaaggaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccagccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttg

SEQ ID NO: 28423 - DNA, 3044 bp, Homo sapiens
cctgggcgacagcgagactccatctcaataaataaaaaaaaaaaagagttgttatcagtagaagggaatgtctggttacagtatggcgttgtgcagatgaaggtcttatcgcagatgaagccaccaggtcacaagcctcagagagaatcaactataaatgcttctcatcagactcaaggcctgaggtgatgctgatgctgtgcctgaattccagcagggaggaggcatgagggcagtgctgtcacagaagacaacaccgctccctcgttacctgtggcccggccacctcagcggcccaaggaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttg

SEQ ID NO: 28424 - DNA, 2503 bp, Homo sapiens
actcgggaaggccacacagccagtgacgaagctgtgattcacacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctg

SEQ ID NO: 28425 - DNA, 3507 bp, Homo sapiens
ccacaagagcccgcggtggcgctgccaggggatgctagcccgagagcgagcagaggagcagcgcacccgcacgagccttggaccctttggaaccgaaagcacgcccgtcctcagagtcccgtcctcaaagtcccatcctcgccatggcacccggagagaagatcaaagccaaaatcaagaagaatctgcccgtgacgggccctcaggcgccgaccattaaagagctgatgcggtggtactgcctcaacaccaacacccatggctgtcgccgcatcgtggtgtcccgcggccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtacagcaccgttcgccaccttctagctgacttggaacaggagaccagagaggccctgaagtccctgtatggctttccagagtcccggaagcgccgagaggcggagtcctggaactccgtctcagagggaaagcagcctagattctcccaccggattccgctgctgatctttgatcaggatgagaagggcaaggccagggacttcttcacagggaggaagcggaaagtcggcggtagcatcattcacaaggcttcaaatgtcatgcacatcgagtccaagcaagtggtgggattccaactgtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggaatttcacgcttttccaccacccgatgcatgggaattgctatactttcaacaacagagaaaatgagaccattctcagcacctccatggggggcagcgaatatgggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctgacagagtccttcaagctgagtgagccctacagtcagtgcacggaggacgggagtgacgtgccaatcaggaacatctacaacgctgcctactcgctccagatctgccttcattcatgcttccagacaaagatggtggagaaatgtgggtgtgcccagtacagccagcctctacctcctgcagccaactactgcaactaccagcagcaccccaactggatgtattgttactaccaactgcatcgagcctttgtccaggaagagctgggctgccagtctgtgtgcaaggaagcctgcagctttaaagagtggacactaaccacaagcctggcacaatggccatctgtggtttcggagaagtggttgctgcctgttctcacttgggaccaaggccggcaagtaaacaaaaagctcaacaagacagacttggccaaactcttgatattctacaaagacctgaaccagagatccatcatggagagcccagccaacagtattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagagcccttggagtgttggtggagatcagagtgccgtggtggaggtctgggactatgtcagagtgtcctcactttggggcatgggtgggtccaggagatggatttagttattcaattttgtggatgaataaattgaggcacagaaagattaagttaccggcccaaggtgacacagtgaggaggtggcagagctaggatttgaacccagacaatctgacttcatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccaca

SEQ ID NO: 28426 - DNA, 7205 bp, Homo sapiens
gagcgctccaagatggcgcccaccgcagtcccgcccgccgcatcctcggcgcctttgcagtccggccgcgcctcccgggccccgcgttagggccgccgctgcctccctcgccgccgccgctgccagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctctaacatacagccattgttgcacattttgcaagatgaactatttaatgctgctctgtgtccagtacatgggggagactttgatcccaaatggcttgtactatttatgtcactgtaaaaccaaatcctagggct

SEQ ID NO: 28427 - DNA, 5820 bp, Homo sapiens
atggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttag

SEQ ID NO: 28428 - DNA, 3858 bp, Homo sapiens
tttctttctccacagacctttgtagtattaaacagagggaaaactctcttcagatttagtgccacgcctgccttgtacattttaagtccttttaacctgataagaagaatagctattaaaattttgatacattcattatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtaccattaaatttgtctggcttaatttaatggggacttctgggacctgcagagactgtaaagggcgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaa

SEQ ID NO: 28429 - DNA, 6958 bp, Homo sapiens
agctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctctaacatacagccattgttgcacattttgcaagatgaactatttaatgctgctctgtgtccagtacatgggggagactttgatcccaaatggcttgtactatttatgtcactgtaaaaccaaatcctagggct

SEQ ID NO: 28430 - DNA, 3253 bp, Homo sapiens
gagacgcgagtctgagagcctgcgggcgggcggcgcgctgcaggcgagcgggcgagcgggcgcgccctgcagggagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcatatgtgacagagtttgtggacctgggcaatgtctcagcgctgagaacattcagggttctccgagctttgaaaactatctctgtaattccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggttagtactaatttgtagatatttttgttctacaccctgaatattctacccctggcccagaagcccaagtccttctactgcttagtccttctactacccgtcatgtttgttgatttttattctttcttggcccagaaaccctaaggtacaaatgaaggagaggagagagatacttacagagtgcctacttagtcatgacccccacaacttgtcaacccttttcc

SEQ ID NO: 28431 - DNA, 8112 bp, Homo sapiens
atggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatt

SEQ ID NO: 28432 - DNA, 8097 bp, Homo sapiens
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatt

SEQ ID NO: 28433 - DNA, 5946 bp, Homo sapiens
atggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttgggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataa

SEQ ID NO: 28434 - DNA, 8133 bp, Homo sapiens
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 28435 - DNA, 1447 bp, Homo sapiens
ccggtcccagagccgcagctgctgcgcccgcgcgctcccggggacattctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcctcggaatacctggccatcacctctgaaagcaaagagaactgcacgggcgtccaggtggccgaatagccctggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggcggtgaggtgggggcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtcccccctccctgtaatgcactcctgccccggcccaacctcgccctctctcaccagccttgaactgtggccacctagaaaggggcccattcagcctcgtctctttacagaagtagttttgttcatgaaataaagactcttggacttg

SEQ ID NO: 28436 - DNA, 1112 bp, Homo sapiens
ccggtcccagagccgcagctgctgcgcccgcgcgctcccggggacattctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaaggtgagtcgggtgctgcctgcccctttaccgtcacccaccggagagccagatggagggacagatggcaggcagtggacaggacaggctggctctgtgcctggccagccaaccgcccacagcagcgggctgagggggaggggagcagcccctcctgcccactccagctctggcctctgtttctctccagcccacggagaggtcaaagcatgcctgtcccccacagacgctccgggtacagaacccagctctgtcacctgtgctgtatgacctctggcaggtgccttctgtctctgagccaaagggttgtcctgggcttgcccgggataataatccgatgtgtttctcggggtgtggtttgagccattcttccatcatggggttcatgaggattgagcagctgcaggcacacgcctggcttccagcagagccttgcaggtggtggcgagggtggcggttcttactgttcgagtagctcagccctgctgccctctgtggtgatgaggcaagagagcgtgccacctagagcagagt

SEQ ID NO: 28437 - DNA, 8403 bp, Homo sapiens
aaaaaaaagatttttttttttttaaagcatgatggaattttagctgcagtcttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaa

SEQ ID NO: 28438 - DNA, 8792 bp, Homo sapiens
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacatttt

SEQ ID NO: 28439 - DNA, 6274 bp, Homo sapiens
cactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatggg

SEQ ID NO: 28440 - DNA, 8792 bp, Homo sapiens
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacatttt

SEQ ID NO: 28441 - DNA, 1801 bp, Homo sapiens
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacag

SEQ ID NO: 28442 - DNA, 5826 bp, Homo sapiens
ttttctctcccccccatctctctctctctcctttacacactccctctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcccgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcagccacactactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaaaaaaaaaaaaaaaaggcaattgtgcggagccaaccatcactgccattacactcacattcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcaacagagccatcattttcccagtgggaggggcctctgtgtcctggtctatgatggggcgagttggaggggtgggcttctctagccctgccccctcccaggagcccagcccctctggccaggactgaggaggagtggagggaagcagggagggagggagcaagtgtgaagggcacagctgctggcaaatgccccattccctgccccagcacttcccagcctttccaggagctctgccccacccctactcaaggagtcaggtgcccagggtagggaataagtctaggaaagggggtggagacaggaccgtgacagtctcagggaccaatccctgcctctgcccatcagattgccaatttggggagacagcaatatcatctgggagattcagcttaatttgcttcaattcagcaaccatttattgagcatctattatgtgccaggcactgtgccgggcactggggatatacacaaagccataagcactggggactgccaggttggcactgtagggaccaagattaactttttggtgcatctaattccacctctgcaagacactgcttccaaggctacagttggggaagatgaagagattctagaatctgtgccctgggaagggagaaacagcagggaagaggggcaatacaacagggtcaagggtgcagaggccaggcagagtgggtgcagagtgggggatgggcaaccagcctggtaacacctgggtgaggtgagcgagtcaagcccatctggaaatgctaaactcatcagctcagtacctaactgccaatcaacacactgccaatgcgggtgggctaagccgccaggatgcctgcagcagatggacgctgcccatccttgagccagccagctgggggcagagaggtgggtggcgggcacctcatgccagctgagaccaagagtggttgtatacatttctgcagcttgcagatttcatttttttggtcaccctttaagtgtccttctctcccaggatgagtgaggagctgtgctgatgttgggaacttatctttttccaggatccataacatttaggggaattatttgcgggctttcctagtgtattctaagaagttctaactctccatcaagaagcccaagattcctggagtctttttttcctctgccctgatcaactggggcccaggaaaagcaatgtctcttcacgggcctcagggccccagcagatggggctgggtcaggaaccatctctgtcccaggtgctcagccctcatatgcattttcttctggagcctcttagaatctcctccagaggactcatagagctgcctcccccaggatggtgaagttgggagcaaaatggggcttctgtaagtagaggtggaaaaccagagagatgtttccacagcagccatttccctaccctgtttcctaacttatgctgacaagttcttcctcttcctaccgtggggttcgagccccacttctggttgcatgttcccaccaccacgctctgctggttttagtcggctgactttctcaactgccccagcctctcctgctctctcagaacctccctctgcccccaccccccatctgtctcttcctcctaattaagggccactgcaaagagagacgggctggctaacccatgggatttagcttataagaacaaagcacaattattcaggactgaactgctttgaggtgccttggaactggctttggaaatagctatctgccccctagctatggactcttcacagttatttccagtttataaaaaggaaaagctgatcggatccatgtttctctctgcgagtctccttggggaggttgggctggtaaatatttgcaaggtcaggttaagcagacagacaattgaaaatactgggcaggtccaaaaggatagttccaggccataggaatggcttggtgcagttaacgggtgatgaagcaagaaatcttccttcctacttatgtcttaaagatggacagcctgtgtctcttgctgtgcctcttgctggcgtcttcctttattgaagcttgctgatgcactgtacatagtctctctctctaggtatagatatattatatatacaaatatcaaacatctcaccacacccaccccaaaagttacactgtgtgtgtgtggggaggtgtaataacttctcagtgttttgagttgattcaccaaaggcaaattttggaatgttcttgcgctttgtgcacttggaggggaaaacccaactacatatgcactttcttggttgtgtgtgctatagagaggttggaaggggtggttggaaggggagagaaactgagatggccctctgtgactcgactgctgggatgtatctgcttttgggagcagactgagtttcttttgcaatttgtcttattgtttgggtctactggcaacaataaactatctcccctgaaaatccctcgagtgtggctttattcaggggttcagggcagggtaggctgatgcttcaccaggatcttaactggaaccctaggtgctcctttcctggtaatcccattggcgctgccagatctccagcatctgagggcctcaatgcccctgcctcacaaggggaaggttgtctaccccacacttgtgcccccacagatgtttcatccctttgccttccccaaccccctggggactccgctcaccctggaacagagtggctgaacacctacttcttggagggctctcgattattttggggatgaagacaaccccggaagctcccaaggctgactgtcatgcggatgttgcctgtcctttgcatgggcagacaggccatccttcctgctctgttccccaaaggtgttggattagacatttcttttgcctcctctggactcagaaagaatagatgacagctggtcagagtctgccctcatgcagttcatggagaagggtggctgtgggaaggttcaggtggctcatgtcccatctacatactgctggatcctatatatatgtgccaaagcagccctaagaagtttaggaccaagggcaacctcctggctaggggctccactgtcccagacaggcctttttttctcccttgctcttcattcttccgtctctttgcatttctccctctctcccttgcaccgctctctctctctctctctctctctctctgtctgtctgtctctctctctcttgcctaggaggcttaccaggcttaccttcctcttcctactctggggttcgagccccacttctggctgcatgctccggccaccacgctctggtggtttcagtctgctgactttct

SEQ ID NO: 28443 - DNA, 9091 bp, Homo sapiens
gaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctagatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtgg

SEQ ID NO: 28444 - DNA, 9123 bp, Homo sapiens
accatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctagatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggctaattgg

SEQ ID NO: 28445 - DNA, 6599 bp, Homo sapiens
taccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttt

SEQ ID NO: 28446 - DNA, 4144 bp, Homo sapiens
aggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtg

SEQ ID NO: 28447 - DNA, 1216 bp, Homo sapiens
agaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggggaaaagctgagagtctggaactagcctatcttccgaggacttagagacaacagtatgggaatttcaacgagacgtttttactttcttttgaccaagattcaaattctttattccagcccttgataagtaaataagaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatgg

SEQ ID NO: 28448 - DNA, 1908 bp, Homo sapiens
attttctgagattggtaaggagtaaggaaactgaggcccaaagaacatacgaatcatgccccaagtcacaaatcttgtaattgccagaactgggacttgacaaggccccataaattctctaagtgacttgactttaccatatttataagagtagttggagctggaatgtgagggagcagggtaagaggggaaaggattgaactgactttactagagttctttaaaaattaaaacatggtcacttcatgacctttgatttttgaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagca

SEQ ID NO: 28449 - DNA, 5665 bp, Homo sapiens
tgtcagggctgacagcacacacggcctgggggcctagagaagggttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcaataaagtatccctgaaaacc

SEQ ID NO: 28450 - DNA, 6061 bp, Homo sapiens
cagggctgacagcacacacggcctgggggcctagagaagggttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagaggtgaatcaacctggacccttccacagcctggctgctaggccagcagtgcgactcccttccgagctgagcttaccctgggcgcaaacgagcgaggcaggggcgcgagtggaagctggagttccggggtgggcggggaggcgactgtccgtggtgctgagcgccggcgagagcgggcgcggagcggctgatcggctccctcgaactggggaggtccagtggggtcgcttagggcccaaagcccccacccggctccaaaagctcccagggcctccccaggcaccggtgctcggcccttccttcggtcagaaagtcgccccctgggggcagttcgtcccaaagggtttcctcgaaagaatctgagagggcgcagtccttgaccgagggaatctctctgtgtagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcaataaagtatccctgaaaacc

SEQ ID NO: 28451 - DNA, 566 bp, Homo sapiens
gagaactggaaggcatggggtctgggaggcgaagccaggaaccgcgtacggcgcgccttgcagatgacatcattgcctgaaagagctctggcccttctcttcccggagctacacccgccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatcc

SEQ ID NO: 28452 - DNA, 3984 bp, Homo sapiens
tgtcagggctgacagcacacacggcctgggggcctagagaagggttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtgacctacaggaacatgggaggggaaggcagatgtggatggcaggttgtacaagtgactttgttgcccacaactgaagtgactttaaatttggtcccttaggtcactgtctaccctgcctggggtccccgccctcagggtaattctttaagtcagaaagctctgtatgatgtcagcgcttcggaaggtgaactgctttgacctgagtgtcgaggcaatctgaacttgcccatggtaacagaggcacaggattctccaactcccttctttggtcaaagaatttttgggctgggctgggctggactgggtgggaaattctcagtgagttattttatctttggtaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactca

SEQ ID NO: 28453 - DNA, 7805 bp, Homo sapiens
ccagcaccccggggctgcgcactgcagctccccaggccacccaccacccttctggtctctgagcccaggatgcgaggatggccagaccatctctgtgcaccctggtgcctctgggccctgagtgcttgcgccccttcacccgggagtcactggcagccatagaacagcgggcggtggaggaggaggcccggctgcagcggaataagcagatggagattgaggagcccgaacggaagccacgaagtgacttggaggctggcaagaacctacccatgatctacggagaccccccgccggaggtcatcggcatccccctggaggacctggatccctactacagcaataagaagaccttcatcgtactcaacaagggcaaggccatcttccgcttctccgccacacctgctctctacctgctgagccccttcagcgtagtcaggcgcggggccatcaaggtgctcatccatgcgctgttcagcatgttcatcatgatcaccatcttgaccaactgcgtattcatgaccatgagtgacccgcctccctggtccaagaatgtggagtacaccttcacagggatctacacctttgagtccctcatcaagatactggcccgaggcttctgtgtcgacgacttcacattcctccgggacccctggaactggctggacttcagtgtcatcatgatggcgtacctgacagagtttgtggacttgggcaacatctcagccctgaggaccttccgggtgctgcgggccctcaaaaccatcacggtcatcccagggctgaagacgatcgtgggggccctgatccagtcggtgaaaaagctgtcggatgtgatgatcctcactgtcttctgcctgagcgtctttgcgctggtaggactgcagctcttcatgggaaacctgaggcagaagtgtgtgcgctggcccccgccgttcaacgacaccaacaccacgtggtacagcaatgacacgtggtacggcaatgacacatggtatggcaatgagatgtggtacggcaatgactcatggtatgccaacgacacgtggaacagccatgcaagctgggccaccaacgatacctttgattgggacgcctacatcagtgatgaagggaacttctacttcctggagggctccaacgatgccctgctctgtgggaacagcagtgatgctgggcactgccctgagggttatgagtgcatcaagaccgggcggaaccccaactatggctacaccagctatgacaccttcagctgggccttcttggctctcttccgcctcatgacacaggactattgggagaacctcttccagctgacccttcgagcagctggcaagacctacatgatcttcttcgtggtcatcatcttcctgggctctttctacctcatcaatctgatcctggccgtggtggccatggcatatgccgagcagaatgaggccaccctggccgaggataaggagaaagaggaggagtttcagcagatgcttgagaagttcaaaaagcaccaggaggagctggagaaggccaaggccgcccaagctctggaaggtggggaggcagatggggacccagcccatggcaaagactgcaatggcagcctggacacatcgcaaggggagaagggagccccgaggcagagcagcagcggagacagcggcatctccgacgccatggaagaactggaagaggcccaccaaaagtgcccaccatggtggtacaagtgcgcccacaaagtgctcatatggaactgctgcgccccgtggctgaagttcaagaacatcatccacctgatcgtcatggacccgttcgtggacctgggcatcaccatctgcatcgtgctcaacaccctcttcatggccatggaacattaccccatgacggagcactttgacaacgtgctcactgtgggcaacctggtcttcacaggcatcttcacagcagagatggttctgaagctgattgccatggacccctacgagtatttccagcagggttggaatatcttcgacagcatcatcgtcaccctcagcctggtagagctaggcctggccaacgtacagggactgtctgtgctacgctccttccgtctgctgcgggtcttcaagctggccaagtcgtggccaacgctgaacatgctcatcaagatcattggcaattcagtgggggcgctgggtaacctgacgctggtgctggctatcatcgtgttcatcttcgccgtggtgggcatgcagctgtttggcaagagctacaaggagtgcgtgtgcaagattgccttggactgcaacctgccgcgctggcacatgcatgatttcttccactccttcctcatcgtcttccgcatcctgtgcggggagtggatcgagaccatgtgggactgcatggaggtggccggccaagccatgtgcctcaccgtcttcctcatggtcatggtcatcggcaatcttgtggtcctgaacctgttcctggctctgctgctgagctccttcagcgccgacagtctggcagcctcggatgaggatggcgagatgaacaacctgcagattgccatcgggcgcatcaagttgggcatcggctttgccaaggccttcctcctggggctgctgcatggcaagatcctgagccccaaggacatcatgctcagcctcggggaggctgacggggccggggaggctggagaggcgggggagactgcccccgaggatgagaagaaggagccgcccgaggaggacctgaagaaggacaatcacatcctgaaccacatgggcctggctgacggccccccatccagcctcgagctggaccaccttaacttcatcaacaacccctacctgaccatacaggtgcccatcgcctccgaggagtccgacctggagatgcccaccgaggaggaaaccgacactttctcagagcctgaggatagcaagaagccgccgcagcctctctatgatgggaactcgtccgtctgcagcacagctgactacaagccccccgaggaggaccctgaggagcaggcagaggagaaccccgagggggagcagcctgaggagtgcttcactgaggcctgcgtgcagcgctggccctgcctctacgtggacatctcccagggccgtgggaagaagtggtggactctgcgcagggcctgcttcaagattgtcgagcacaactggttcgagaccttcattgtcttcatgatcctgctcagcagtggggctctggccttcgaggacatctacattgagcagcggcgagtcattcgcaccatcctagaatatgccgacaaggtcttcacctacatcttcatcatggagatgctgctcaaatgggtggcctacggctttaaggtgtacttcaccaacgcctggtgctggctcgacttcctcatcgtggatgtctccatcatcagcttggtggccaactggctgggctactcggagctgggacccatcaaatccctgcggacactgcgggccctgcgtcccctgagggcactgtcccgattcgagggcatgagggtggtggtgaacgccctcctaggcgccatcccctccatcatgaatgtgctgcttgtctgcctcatcttctggctgatcttcagcatcatgggtgtcaacctgtttgccggcaagttctactactgcatcaacaccaccacctctgagaggttcgacatctccgaggtcaacaacaagtctgagtgcgagagcctcatgcacacaggccaggtccgctggctcaatgtcaaggtcaactacgacaacgtgggtctgggctacctctccctcctgcaggtggccaccttcaagggttggatggacatcatgtatgcagccgtggactcccgggagaaggaggagcagccgcagtacgaggtgaacctctacatgtacctctactttgtcatcttcatcatctttggctccttcttcaccctcaacctcttcattggcgtcatcattgacaacttcaaccagcagaagaagaagttaggggggaaagacatctttatgacggaggaacagaagaaatactataacgccatgaagaagcttggctccaagaagcctcagaagccaattccccggccccagaacaagatccagggcatggtgtatgacctcgtgacgaagcaggccttcgacatcaccatcatgatcctcatctgcctcaacatggtcaccatgatggtggagacagacaaccagagccagctcaaggtggacatcctgtacaacatcaacatgatcttcatcatcatcttcacaggggagtgcgtgctcaagatgctcgccctgcgccagtactacttcaccgttggctggaacatctttgacttcgtggtcgtcatcctgtccattgtgggccttgccctctctgacctgatccagaagtacttcgtgtcacccacgctgttccgtgtgatccgcctggcgcggattgggcgtgtcctgcggctgatccgcggggccaagggcatccggacgctgctgttcgccctcatgatgtcgctgcctgccctcttcaacatcggcctcctcctcttcctggtcatgttcatctactccatcttcggcatgtccaactttgcctacgtcaagaaggagtcgggcatcgatgatatgttcaacttcgagaccttcggcaacagcatcatctgcctgttcgagatcaccacgtcggccggctgggacgggctcctcaaccccatcctcaacagcgggcccccagactgtgaccccaacctggagaacccgggcaccagtgtcaagggtgactgcggcaacccctccatcggcatctgcttcttctgcagctatatcatcatctccttcctcatcgtggtcaacatgtacatcgccatcatcctggagaacttcaatgtggccacagaggagagcagcgagccccttggtgaagatgactttgagatgttctacgagacatgggagaagttcgaccccgacgccacccagttcatcgcctacagccgcctctcagacttcgtggacaccctgcaggaaccgctgaggattgccaagcccaacaagatcaagctcatcacactggacttgcccatggtgccaggggacaagatccactgcctggacatcctctttgccctgaccaaagaggtcctgggtgactctggggaaatggacgccctcaagcagaccatggaggagaagttcatggcagccaacccctccaaggtgtcctacgagcccatcaccaccaccctcaagaggaagcacgaggaggtgtgcgccatcaagatccagagggcctaccgccggcacctgctacagcgctccatgaagcaggcatcctacatgtaccgccacagccacgacggcagcggggatgacgcccctgagaaggaggggctgcttgccaacaccatgagcaagatgtatggccacgagaatgggaacagcagctcgccaagcccggaggagaagggcgaggcaggggacgccggacccactatggggctgatgcccatcagcccctcagacactgcctggcctcccgcccctcccccagggcagactgtgcgcccaggtgtcaaggagtctcttgtctagcaggcagcatcggggtggcccactgagtctcggcatagtccccagagctcccccgtggtgcctgcacacagagtgagggaggagggctttgaatctgggactgtgcctggctccctgatgggggacaggatttggccacactggggctgacacccaggcccgagcgcctgcgttcccagaccatgggaaatgggaattgcgctcaggggctccatgctgggtctgaggcccctgcctccaagatttaacctgcaagttgctctgacctcctctgggccctgtcgcccctccttttggcctgggggaggtcagaacattcgaatctctgcccctcacttgaggaggagctggcctgcggtggagggatcagttgccccccatcaccagagtcttaagggtcactggcctctccccaggaagtggctcagacccctcagccccagcccagacaaagatgtcttaacctcagggagtgcagacacctaaccccagggcactgccagcccaccccctttgactctggggtgcagcttcacccaccaggccagctcaggaattccctggaaaagggaaatgtgactggttcagaaatagctcctcaaagcctcaaaacctgattggccactggatcctgctgctttgggctgggatggtgactcctgaaacctcttcctaggccacgtccaggtccgtagctcccctggctggctcctaggggaagagcagaaggaaggatgccacttgggaatgaattgtccttttctaggaagcacgggggagtgagacaggctgggtcctgccagctggatcgctgcacatggcctgagcatccagacctgagcgggagtcagggacctgctgctcagtaagaagattctcgccccttccctctctccctgcctcactcctccgtgagcaccaccagggctccaggagcctcatccagcctcagagatctcccttctcatctccccacgcccgtctctttctcacctttcccacctctctccccaaagtgatcctaagaatgtacagttgagctcaggttagatatttcgaccctggggcgtgcagcagggaaggcccaactggttcaggctcaaccttccaacttcctgtggcctgaagaagcacttctgctgcatcgctgttctgggcatggcagggccaggcctctgctggctcaggaggaggggtgagagacctgctcaggcgtcgctggatttattcacttgtgtgtgtacctgtggctgtgtgtctgcttgtatgcttttataggcctgtgtgtatagctgtgtgtgtgttcaagtgcgtgactgtatgtgtgtgtgtgaaccactgtgtactggagcctgcattatgcacgtgtctgggtatctttgtatatatgtgtatatatgtgtgccctggactgtttcaaggtccatggagtacggctggtgtgtcatactgtgcaggcctgtccctgggagtgttcccgtgcctgggagagtggacctgtgctgtgagtgtgtggatgcgtgtgaacgcatgtggtaaggtgtgtactcagggcattctgttggcctaagtgcctcttctttttcttcttgtttctcatgaaaagtttgattaaaattcaggaagcagcaaaaccttcaaaacaagacatgtatgtgtgcttgagtgtgtgaacacgtgtgtgtgtgtgcacatctacatgccatgcctatgggccagagttgtctttattgtccaccatgctctctcacctgctcccagtcctgcctgaacagccctctctctcactcccctctcctccccttcctgtttctcgttgtcacacccatggcctcagccctgctccctgcctcctgcctatgtctcctctatggaaggaggcctccactccttccatctcttccttcagaagtttcgtctaatgggggcagtctccccttcctggcacattgcccctctgccttgccctcctgggccctgggctggcacagcccctggagcctcagaaatctgtttgattggatattctcctcggactgtgtgcaggttgcagaggaagagtagatgagccgggtccggcctctccctgcctgtggcccctcccctgcagacggatgcccattcctgcctggtccagtggggaacaggtcccacgccaggccagcaggcgggctcctttgtacagttcttacaataaaccctccttggtgcctctgg

SEQ ID NO: 28454 - DNA, 4484 bp, Homo sapiens
ctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttgggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaacaacatttccattgtgctgagggacctggagttcagcgacacgggcaaatacacctgccatgtgaagaaccccaaggagaataatctccagcaccacgccaccatcttcctccaagtcgttgatagactggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggggaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctcccccccccccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaataa

SEQ ID NO: 28455 - DNA, 566 bp, Homo sapiens
agcagccggctcccagcagcgggcgagcgcgcctccccctccgctccctccctccccctcctctcgctctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttggtggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccc

SEQ ID NO: 28456 - DNA, 9787 bp, Homo sapiens
cggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactctaccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttat

SEQ ID NO: 28457 - DNA, 9787 bp, Homo sapiens
cggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactctaccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcatatgtgacagagtttgtggacctgggcaatgtctcagcattgagaacattcagagttctccgagcattgaaaacaatttcagtcattccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttat

SEQ ID NO: 28458 - DNA, 5967 bp, Homo sapiens
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatag

SEQ ID NO: 28459 - DNA, 9768 bp, Homo sapiens
gggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 28460 - DNA, 1618 bp, Homo sapiens
attctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcatatgtgacagagtttgtggacctgggcaatgtctcagcattgagaacattcagagttctccgagcattgaaaacaatttcagtcattccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcc

SEQ ID NO: 28461 - DNA, 335 bp, Homo sapiens
agtggacactgtgggcatgcgtgtccgtgcagcacatcgccatgcaggagcctgggggaaggcctttccctcagtgagggctgcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccaga

SEQ ID NO: 28462 - DNA, 8456 bp, Homo sapiens
gccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttac

SEQ ID NO: 28463 - DNA, 341 bp, Homo sapiens
tcatggcccagcacgaccctccaccctggaccaagtatgtcgagtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatcc

SEQ ID NO: 28464 - DNA, 8504 bp, Homo sapiens
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 28465 - DNA, 8303 bp, Homo sapiens
ggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtgtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatgacctgg

SEQ ID NO: 28466 - DNA, 8362 bp, Homo sapiens
cagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 28467 - DNA, 8450 bp, Homo sapiens
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtgtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 28468 - DNA, 8501 bp, Homo sapiens
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 28469 - DNA, 5898 bp, Homo sapiens
gatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtga

SEQ ID NO: 28470 - DNA, 6284 bp, Homo sapiens
ggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgag

SEQ ID NO: 28471 - DNA, 8343 bp, Homo sapiens
gagacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 28472 - DNA, 7170 bp, Homo sapiens
ctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcagg

SEQ ID NO: 28473 - DNA, 5727 bp, Homo sapiens
gtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatatggatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcagtgagtttaaagtgggttaaagtggccatttgacaatctcatatttgttttctctacatggcttatatgatgtgtgccttctagggaatgaagggaagtggtgatagagatcagcagcagcaggggctttcttttatattttatgtataatttaatgggctttaagtcaccactattaagacttacaaataagcaaatactttcctgatgtgggatggtgaaatgctaatggccattaaatcataaacttgcctagacaaaagccaattggaagaagggagagagcagttctttagaaagtgcctttgagatcaacctcagagattcttgggctgattaaaactgcatttg

SEQ ID NO: 28474 - DNA, 7183 bp, Homo sapiens
gtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatatggatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcagtgagtttaaagtgggttaaagtggccatttgacaatctcatatttgttttctctacatggcttatatgatgtgtgccttctagggaatgaagggaagtggtgatagagatcagcagcagcaggggctttcttttatattttatgtataatttaatgggctttaagtcaccactattaagacttacaaataagcaaatactttcctgatgtgggatggtgaaatgctaatggccattaaatcataaacttgcctagacaaaagccaattggaagaagggagagagcagttctttagaaagtgcctttgagatcaacctcagagattcttgggctgattaaaactgcatttgaaaaagattggttgaagctctgtgtttatttttgtatgttcttgttttcatttggaactgggaatgaataggatttcattgtgctcaagctcctggtttctcatctctggatagtttcacctaagctctggctcttaagcaggacagattcgtaaaacaagaagcataaaggagaggtatagccttttttttttttttttttttcattttcttctcatttacacctatttttttaaaaagtatacatttactaaaatgatgtaataaataacatgttaatagactcaagctttaccttatgaaattgatgtatttttaccagttatttctaatgtaacattgaatatataagatctgacaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccaca

SEQ ID NO: 28475 - DNA, 2996 bp, Homo sapiens
ctccactggacatctgggtaggaggggtctctgggtcagtggctggagagtcgccccagtgagtcggtgtctaactggccatttagtggggcccatttactgcagagccacagctggtgaggacagacgccagcctaacagcagcttctgtacaactagagctcagaaaacccgagagatccgtggagaaagagaagcccaggaggaggaaagggctccaaggagccctgctcctgaagggtccctcaggcactggtggagacctgtcgcttcgtagcaagtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaa

SEQ ID NO: 28476 - DNA, 1459 bp, Homo sapiens
ctggagagtcgccccagtgagtcggtgtctaactggccatttagtggggcccatttactgcagagccacagctggtgaggacagacgccagcctaacagcagcttctgtacaactagagctcagaaaacccgagagatccgtggagaaagagaagcccaggaggaggaaagggctccaaggagccctgctcctgaagggtccctcaggcactggtggagacctgtcgcttcgtagcaagtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcaga

SEQ ID NO: 28477 - DNA, 6418 bp, Homo sapiens
atggaattccccattggatccctcgaaactaacaacttccgtcgctttactccggagtcactggtggagatagagaagcaaattgctgccaagcagggaacaaagaaagccagagagaagcatagggagcagaaggaccaagaagagaagcctcggccccagctggacttgaaagcctgcaaccagctgcccaagttctatggtgagctcccagcagaactgatcggggagcccctggaggatctagatccgttctacagcacacaccggacatttatggtgctgaacaaagggaggaccatttcccggtttagtgccactcgggccctgtggctattcagtcctttcaacctgatcagaagaacggccatcaaagtgtctgtccactcgtggttcagtttatttattacggtcactattttggttaattgtgtgtgcatgacccgaactgaccttccagagaaaattgaatatgtcttcactgtcatttacacctttgaagccttgataaagatactggcaagaggattttgtctaaatgagttcacgtacctgagagatccttggaactggctggattttagcgtcattaccctggcatatgttggcacagcaatagatctccgtgggatctcaggcctgcggacattcagagttcttagagcattaaaaacagtttctgtgatcccaggcctgaaggtcattgtgggggccctgattcactcagtgaagaaactggctgatgtgaccatcctcaccatcttctgcctaagtgtttttgccttggtggggctgcaactcttcaagggcaacctcaaaaataaatgtgtcaagaatgacatggctgtcaatgagacaaccaactactcatctcacagaaaaccagatatctacataaataagcgaggcacttctgaccccttactgtgtggcaatggatctgactcaggccactgccctgatggttatatctgccttaaaacttctgacaacccggattttaactacaccagctttgattcctttgcttgggctttcctctcactgttccgcctcatgacacaggattcctgggaacgcctctaccagcagaccctgaggacttctgggaaaatctatatgatcttttttgtgctcgtaatcttcctgggatctttctacctggtcaacttgatcttggctgtagtcaccatggcgtatgaggagcagaaccaggcaaccactgatgaaattgaagcaaaggagaagaagttccaggaggccctcgagatgctccggaaggagcaggaggtgctagcagcactagggattgacacaacctctctccactcccacaatggatcacctttaacctccaaaaatgccagtgagagaaggcatagaataaagccaagagtgtcagagggctccacagaagacaacaaatcaccccgctctgatccttacaaccagcgcaggatgtcttttctaggcctcgcctctggaaaacgccgggctagtcatggcagtgtgttccatttccggtcccctggccgagatatctcactccctgagggagtcacagatgatggagtctttcctggagaccacgaaagccatcggggctctctgctgctgggtgggggtgctggccagcaaggccccctccctagaagccctcttcctcaacccagcaaccctgactccaggcatggagaagatgaacaccaaccgccgcccactagtgagcttgcccctggagctgtcgatgtctcggcattcgatgcaggacaaaagaagactttcttgtcagcagaatacttagatgaacctttccgggcccaaagggcaatgagtgttgtcagtatcataacctccgtccttgaggaactcgaggagtctgaacagaagtgcccaccctgcttgaccagcttgtctcagaagtatctgatctgggattgctgccccatgtgggtgaagctcaagacaattctctttgggcttgtgacggatccctttgcagagctcaccatcaccttgtgcatcgtggtgaacaccatcttcatggccatggagcaccatggcatgagccctaccttcgaagccatgctccagataggcaacatcgtctttaccatattttttactgctgaaatggtcttcaaaatcattgccttcgacccatactattatttccagaagaagtggaatatctttgactgcatcatcgtcactgtgagtctgctagagctgggcgtggccaagaagggaagcctgtctgtgctgcggagcttccgcttgctgcgcgtattcaagctggccaaatcctggcccaccttaaacacactcatcaagatcatcggaaactcagtgggggcactggggaacctcaccatcatcctggccatcattgtctttgtctttgctctggttggcaagcagctcctaggggaaaactaccgtaacaaccgaaaaaatatctccgcgccccatgaagactggccccgctggcacatgcacgacttcttccactctttcctcattgtcttccgtatcctctgtggagagtggattgagaacatgtgggcctgcatggaagttggccaaaaatccatatgcctcatccttttcttgacggtgatggtgctagggaacctggtggtgcttaacctgttcatcgccctgctattgaactctttcagtgctgacaacctcacagccccggaggacgatggggaggtgaacaacctgcaggtggccctggcacggatccaggtctttggccatcgtaccaaacaggctctttgcagcttcttcagcaggtcctgcccattcccccagcccaaggcagagcctgagctggtggtgaaactcccactctccagctccaaggctgagaaccacattgctgccaacactgccagggggagctctggagggctccaagctcccagaggccccagggatgagcacagtgacttcatcgctaatccgactgtgtgggtctctgtgcccattgctgagggtgaatctgatcttgatgacttggaggatgatggtggggaagatgctcagagcttccagcaggaagtgatccccaaaggacagcaggagcagctgcagcaagtcgagaggtgtggggaccacctgacacccaggagcccaggcactggaacatcttctgaggacctggctccatccctgggtgagacgtggaaagatgagtctgttcctcaggtccctgctgagggagtggacgacacaagctcctctgagggcagcacggtggactgcctagatcctgaggaaatcctgaggaagatccctgagctggcagatgacctggaagaaccagatgactgcttcacagaaggatgcattcgccactgtccctgctgcaaactggataccaccaagagtccatgggatgtgggctggcaggtgcgcaagacttgctaccgtatcgtggagcacagctggtttgagagcttcatcatcttcatgatcctgctcagcagtggatctctggcctttgaagactattacctggaccagaagcccacggtgaaagctttgctggagtacactgacagggtcttcacctttatctttgtgttcgagatgctgcttaagtgggtggcctatggcttcaaaaagtacttcaccaatgcctggtgctggctggacttcctcattgtgaatatctcactgataagtctcacagcgaagattctggaatattctgaagtggctcccatcaaagcccttcgaacccttcgcgctctgcggccactgcgggctctttctcgatttgaaggcatgcgggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggcaacctttaaaggctggatggacattatgtatgcagctgttgattcccgggaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagttagggggccaggacatcttcatgacagaggagcagaagaaatactacaatgccatgaagaagttgggctccaagaagccccagaagcccatcccacggcccctgaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactctatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcatggtcaacatgtacattgcagtgattctggagaacttcaatgtggccacggaggagagcactgagcccctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtgagaacactccagcctggatatgttcagttatgatgcgtccttctgctctgtgttaactctttcccattgcagatcacacccagctacagcctcaccaatgcatgccactggtcacaatgtcagaactgggcagggaatgcaactggtaaccacctttgaaaaaaccatcatacacaaataggagtcagaagctaagagcacttccactgtgatttcccttctgaatttcaatatcagatcatgggttctcttactctccagaaaatatcccttgtccttttatttttgttgtaatcagattatatttactgagacaaacttctcaggaccagaacttccaaagatatagaacaagaacattactgaaggtccaaggtagtcctctgtggagcaccatacagagattggcaatattatttaggattttgcatgactgcatgtgagagctgtcggacaactgctctgacccagggtaacacctgtggcctatgtcatgaaaagcctttgagatatccattaaaattaatatttttaaatgtatgtcc

SEQ ID NO: 28478 - DNA, 6500 bp, Homo sapiens
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgctgtcagcatcctcaccatcaccatgaaggaacaagaaaaatcacaagagccttgtctcccttgtggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagagtgctcagggtcttcaagttagccaaatcctggccaactttgaacacactaattaagataatcggcaactctgtcggagcccttggaagcctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtacaatgatttctaccttggaaaatcaggagcacattcctttccctccgacgctcttcagaattgtccgcttggctcggattggccgaatcctgaggcttgtccgggctgcacgaggaatcaggactctcctctttgctctgatgatgtcgcttccttctctgttcaacattggtcttctactctttctgattatgtttatctatgccattctgggtatgaactggttttccaaagtgaatccagagtctggaatcgatgacatattcaacttcaagacttttgccagcagcatgctctgtctcttccagataagcacatcagcaggttgggattccctgctcagccccatgctgcgatcaaaagaatcatgtaactcttcctcagaaaactgccacctccctggcatagccacatcctactttgtcagttacattatcatctcctttctcattgttgtcaacatgtacattgctgtgattttagagaacttcaatacagccactgaagaaagtgaggaccctttgggtgaagatgactttgacatattttatgaagtgtgggaaaagtttgacccagaagcaacacaatttatcaaatattctgccctttctgactttgctgatgccttgcctgagcctttgcgtgtcgcaaagccaaataaatatcaatttctagtaatggacttgcccatggtgagtgaagatcgcctccactgcatggatattcttttcgccttcaccgctagggtactcggtggctctgatggcctagatagtatgaaagcaatgatggaagagaagttcatggaagccaatcctctcaagaagttgtatgaacccatagtcaccaccaccaagagaaaggaagaggaaagaggtgctgctattattcaaaaggcctttcgaaagtacatgatgaaggtgaccaagggtgaccaaggtgaccaaaatgacttggaaaacgggcctcattcaccactccagactctttgcaatggagacttgtctagctttggggtggccaagggcaaggtccactgtgactgagccctcacctccacgcctacctcatagcttcacagccttgccttcagcctctgagctccaggggtcagcagcttagtgtatcaacagggagtggattcaccaaattagccattccattttcttttctggctaaaataaatgatatttcaatttcattttaaataatacttacagagatataagataaggctacttgacaaccagtggtactattataataaggaagaagacaccaggaaggactgtaaaaggacataccaattttaggattgaaatagttcaggccgggcgcagtggctcatgcctgtaatcccagcactttgagaggccaaggcaggtggatcacgaggtcaagagatcgagaccatcctggccaacatgatgaaactccgtctctactaaaaatacaaaaattagctgggcatggtggcgtgcgcctgtagtcccagctacttgggaggctgaggcaggagaatcgcttaaacctgggagacggaggttgcagtgagccaagatcgtgccactgcactccagcctggtgacagagtgagactctgtttcaaaaaagaaaagaaaagaaacatggttcaaattatatctaaacaaaaaagaataagaaacaaaaaacacattaaaattttaagttgtattttctatgtttctagatacatcatttttgtttgatattttcctgatgcaagtatgtggtttatcacatgtagctcttttgcatgctaaatgaaaattcaaaacttgccaataaatgaatagcttattgcagacattttttaccaacattaattattttgggtttgtttaaaacctagaggcacaatcttgacttgtcaattactaccctttcacaagctaccatctcagatatatatatatatataaattcaataaagctttctgtttgtgttcc

SEQ ID NO: 28479 - DNA, 5729 bp, Homo sapiens
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgctgtcagcatcctcaccatcaccatgaaggaacaagaaaaatcacaagagccttgtctcccttgtggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagagtgctcagggtcttcaagttagccaaatcctggccaactttgaacacactaattaagataatcggcaactctgtcggagcccttggaagcctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtaagtaaaatcagcagtcagagggactttaagaaccagaagtaagtttgtaaatcttatcattttttgaagtttgttcaaactatccacaaagcagaaaactgggccaagtgtactttctgaaagaatagacaggggtactaatgccattctctactgggaagttgctaggagatagagagtaatttctgttcccttaactcactacacaactgaaatagagttcaataatcatgcagctaatgtattcaatggaaatagacaaaattaaaatgactcagaagtttttgtggtggtaacctgatttattcagataattgagtcaaagttctacctttcctgtgcaactataagccctatgagcattttttagttttaaggatttactgcccatgttttttcctttgttcaaaatccacatgggtgccagatcacaattattgtgcccctgtggcactgctgtgccccctttcaacccctatacaaggccccatggcccactctagattgggctttcaagagtatatcattcagacaatcaaagctttttttctattctatatcccatgttaacttaaaccacagtgtgaactgtgcttgtctcagattctttgaccccgcttaccaaccagcctcattctctaatcagtatatttttcctaatcacacgcagggttaactaaaaggcttataaaagaatacaaaagaaagaaggttattaccatactccttcttataaaacacacacatacacacatcaactttaaaattaaattcttcatggctaaaccataagtgcttactctgggtttttgaagtctggttttaattaaactgttaacttgacattttataattatgtaaaactgtccaggagcccttctcatagttcaaaacacaatgaagacaaagaaaactgattttccaaatggaagcttttttgcgatctcagaaagaatgcatcaaacagatatattggatcaagatattttggttcctaatgctactgcagcattgcagatgtttcagagaacaacaacaaatatgctacagttcatagtgtgttctggtttctaagccatgatgttaatgtagataaagcttatcaatagattcttccatgagtttacagttaagtagacctttaatttttattagtcaattccaatcacaagtcttggtgaaattgacagcagcaaaaaa

SEQ ID NO: 28480 - DNA, 6500 bp, Homo sapiens; identical to SEQ ID NO: 28478

SEQ ID NO: 28481 - DNA, 6816 bp, Homo sapiens
ccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcaagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaacttcgcaagtctgttttcagcatcagggcaaggaaccttctggaaaaggagaccgcagtcactaaaatcttaagagcttgcacccgacagcgcatgctgagcggatcatttgaggggcagcccgcaaaggagaggtcaatcctcagcgtgcagcatcatatccgccaagagcgcaggtcactaagacatggatcaaacagccagaggatcagcaggggaaaatctcttgaaactttgactcaagatcattccaatacagtgagatatagaaatgcacaaagagaagacagtgaaataaagatgattcaggaaaaaaaggagcaagcagagatgaaaaggaaagtgcaagaagaggaactcagagagaaccacccatacttcgataagccactgttcattgtcgggcgagaacacaggttcagaaacttttgccgggtggtggtccgagcacgcttcaacgcatctaaaacagaccctgtcacaggagctgtgaaaaatacaaagtaccatcaactttatgatttgctgggattggtcacttacctggactgggtcatgatcatcgtaaccatctgctcttgcatttccatgatgtttgagtccccgtttcgaagagtcatgcatgcacctactttgcagattgctgagtatgtgtttgtgatattcatgagcattgagcttaatctgaagattatggcagatggcttatttttcactccaactgctgtcatcagggacttcggtggagtaatggacatatttatatatcttgtgagcttgatatttctttgttggatgcctcaaaatgtacctgctgaatcgggagctcagcttctaatggtccttcggtgcctgagacctctgcgcatattcaaactggtgccccagatgaggaaagttgttcgagaacttttcagcggcttcaaggaaatttttttggtctccattcttttgctgacattaatgctcgtttttgcaagctttggagttcagctttttgctggaaaactggccaagtgcaatgatcccaacattattagaagggaagattgcaatggcatattcagaattaatgtcagtgtgtcaaagaacttaaatttaaaattgaggcctggagagaaaaaacctggattttgggtgccccgtgtttgggcgaatcctcggaactttaatttcgacaatgtgggaaacgctatgctggcgttgtttgaagttctctccttgaaaggctgggtggaagtgagagatgttattattcatcgtgtggggccgatccatggaatctatattcatgtttttgtattcctgggttgcatgattggactgaccctttttgttggagtagttattgctaatttcaatgaaaacaaggggacggctttgctgaccgtcgatcagagaagatgggaagacctgaagagccgactgaagatcgcacagcctcttcatcttccgcctcgcccggataatgatggttttagagctaaaatgtatgacataacccagcatccattttttaagaggacaatcgcattactcgtcctggcccagtcggtgttgctctctgtcaagtgggacgtcgaggacccggtgaccgtacctttggcaacaatgtcagttgttttcaccttcatctttgttctggaggttaccatgaagatcatagcaatgtcgcctgctggcttctggcaaagcagaagaaaccgatacgatctcctggtgacgtcgcttggcgttgtatgggtggtgcttcactttgccctcctgaatgcatatacttacatgatgggcgcttgtgtgattgtatttaggtttttctccatctgtggaaaacatgtaacgctaaagatgctcctcttgacagtggtcgtcagcatgtacaagagcttctttatcatagtaggcatgtttctcttgctgctgtgttacgcttttgctggagttgttttatttggtactgtgaaatatggggagaatattaacaggcatgcaaatttttcttcggctggaaaagctattaccgtactgttccgaattgtcacaggtgaagactggaacaagattatgcatgactgtatggttcagcctccgttttgtactccagatgaatttacatactgggcaacagactgtggaaattatgctggggcacttatgtatttctgttcattttatgtcatcattgcctacatcatgctaaatctgcttgtagccataattgtggagaatttctccttgttttattccactgaggaggaccagcttttaagttacaatgatcttcgccactttcaaataatatggaacatggtggatgataaaagagagggggtgatccccacgttccgcgtcaagttcctgctgcggctactgcgtgggaggctggaggtggacctggacaaggacaagctcctgtttaagcacatgtgctacgaaatggagaggctccacaatggcggcgacgtcaccttccatgatgtcctgagcatgctttcataccggtccgtggacatccggaagagcttgcagctggaggaactcctggcgagggagcagctggagtacaccatagaggaggaggtggccaagcagaccatccgcatgtggctcaagaagtgcctgaagcgcatcagagctaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgagacaagcagccagcagcagctcctgagccccacgctgtcggatcgaggaggaagtcggcaagatgcagccgacgcagggaaaccccagaggaaatttgggcagtggcgtctgccctcagccccaaaaccaataagccattcagtgtcctcagtcaacttacggtttggaggaaggacaaccatgaaatctgtcgtgtgcaaaatgaaccccatgactgacgcggcttcctgcggttctgaagttaagaagtggtggacccggcagctgactgtggagagcgacgaaagtggggatgaccttctggatatttaggtggatgtcaatgtagatgaatttctagtggtggaaaccgttttctaataatgtccttgattgtccagtgagcaatctgtaattgatctataactgaattccagcttgtcacaagatgtttataaattgattttcatcctgccacagaaaggcataagctgcatgtatgatgggttactatcaatcattgctcaaaaaaatttttgtataatgacagtactgataatattagaaatgataccgcaagcaaatgtatatcacttaaaaatgtcatatattctgtctgcgtaaactaaggtatatattcatatgtgctctaatgcagtattatcaccgccccgcaaaagagtgctaagcccaaagtggctgatatttagggtacaggggttatagctttagttcacatctttcccatttccactagaaatatttctcttgagagaatttattatttatgattgatctgaaaaggtcagcactgaacttatgctaaaatgatagtagttttacaaactacagattctgaattttaaaaagtatcttctttttctcgtgttatatttttaaatatacacaagacatttggtgaccagaacaagttgatttctgtcctcagttatgttaatgaaactgttgcctccttctaagaaaattgtgtgtgcaagcaccaggcaaagaaatggactcaggatgcttagcggtttaaaacaaacctgtagataaatcacttgagtgacatagttgcgcaaagatgttaagtttcttaagaaaccttttaataactgagtttagcaaaaagaataaaactatatagctcaatttatttaaaaaaatctttgcatgtgtgatgttatcattggcttcatttcttacccaaggtatgtctgttttgccataaatcagcagagtcatttcattctgggtgatcctaacacaccattgctacgttagatttgaaatgacatctctgttaaaagaatcttctatggaaataatggtgccctgcaaaatcttcctttgaactcacaggttagggatcacacaacttacttaatcgttttttgtttttgttttttttccttatatgtcaatggcccatgtcctccgggaaaattagaaaagcaaaatgattacaaagtgctgttagatttcttgtgctgggccagccaagtagaagtggacttgacttggacctttaactattttattacagattggacatttgctgttcagatgttttttaacagagggattatctcagaatcctgtgacctccaggttgttttataatctatttttctctatttaacattcctcagatagataggcaaataggacattccttctgtgtcacagaagtatcgtggtagtggcagtctacagtttatatgattcattgtaactatgagataaagaacaaccagtcatgtggccaaaaggattagatttgatttgatgttcacttggagtttactttttgtacatacaagataaaataaatattggatttgtaaaat

SEQ ID NO: 28482 - DNA, 2864 bp, Homo sapiens
gaggggcccgcgtccccgcccgccctgggcgccgcgcctggcactgatcctgccggtcgcccactgtcgccgccgccgccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcaagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgcctccctctcttatccgtgacctctgtggcactcaagacgcctgtccatcctgccttcctctccagcctccaaaccctctgcctggaagccagactctggccagacttactcaccaggccctcaccacaccacctggaatgcgttcctcacagctcttttccaaaatcagtcttctccttggcatctgcgtggcttgggagagcatccttggctctctgtcattgtctcacaatcttcgataagtagtgttcggaaagtgcccccctggcccatgtgcccagatgggctctccaagtctaaatgcttcaaaatggtacagaactaaatgtgtgaatttatgatggggcttcatttctggtcctccttcttcacacttgcgtggccgcccttcccatccgctctccaattttctttcacgtttctgctttctgagaagaaataagactgatttctgggatggagcatgagagagacagatgcagagagagagagagacaaagcgtgtttccgtgggagatgcccacacacctcacttgggagcatcggcagtgttggtacccacacaggtgtgttttgacatccaagacttgaccctaattcttcttggaacctgatggggagagaaccttgctgggggccccacatgggccaggggcagccagggcagagttgggcagctgcctgagagttctcggtggagaggcccggaatatcccacaagaacaagtctccgttagttccaagtggaatgacagccctttctgagtttccctgagttgagagctaatacatgtgttgtgggaacaacagcccaagccaaaggccacgcggaggccaggcgtggtgactcacacctgtaatcctagcactttgggaggccaagatccacggatctcatgagctcaggagttcaagaccagcctggtcaaccttgtctct

SEQ ID NO: 28483 - DNA, 1126 bp, Homo sapiens
gtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccaggactctcactctgacacccaggctggagtgcagtggcatgatctcagcttactgaaacatccatctcccaggttcaagagattctcctgcttcagccccccaagtagctgggactacaggcgtgtgccaccacacccgggtaatttttgtatttttagcagagacagggcttcatcatgttggccaggctggtctcgaactcctgacctcaagagatctgcctgcctcagcctcccaaagtgctgggattaaaggcctgagccaccatgtccagccttatttttaaaaaaaaatttcagttcaatattactgcattttaaagccccacacataagcagaaaaactgtcagcaccattttaccgttactattagcccagacataaatgtagttttactcttagagactcaagaaatatccaaactcaaaataaaacagaaaatgttaattgatttg

SEQ ID NO: 28484 - DNA, 736 bp, Homo sapiens
ccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccaggtttgtcaata

SEQ ID NO: 28485 - DNA, 11696 bp, Homo sapiens
caccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattt

SEQ ID NO: 28486 - DNA, 11538 bp, Homo sapiens
cgactccgctggacctgggacccccagacgtgggaggatgggggtgacctagtgtcttccagtagggcaatctctggacatctttatctccccagtacctctccagatcctgaagcctggggccagggaggagaggttagatgtcagcagtggaaggacagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaa

SEQ ID NO: 28487 - DNA, 11689 bp, Homo sapiens
aggccagagatttattcgagcttcggcgggggagggagcgcagctgggccgcgtttaggctgcaccacccgcgtgtttcagccgctcgactccgctggacctgggacccccagacgtgggaggatggggtgggtgtgcctgcctgtgagtttgggggtgctggaccaaagtgaacacagatgagtcaactccacccattgtctctgcaagaaaacagctcaaaactcaccccatgaatgagagaggaagatgccaccctttgggactgtctgtaccctggcagaaatggaatgatttatccaaataagcaagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaa

SEQ ID NO: 28488 - DNA, 4170 bp, Homo sapiens
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaa

SEQ ID NO: 28489 - DNA, 3652 bp, Homo sapiens
ttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 28490 - DNA, 558 bp, Homo sapiens
acactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtggatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctgaggt

SEQ ID NO: 28491 - DNA, 1999 bp, Homo sapiens
acatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtga

SEQ ID NO: 28492 - DNA, 540 bp, Homo sapiens
ggtgtctgtttatgccgggtccgctgttaattcggagttgagtcattcggggtggattgggggcagattgtggcgcgagatctagaaaaggatcaaggttgagcggatctgcttaaaagtgactgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagg

SEQ ID NO: 28493 - DNA, 566 bp, Homo sapiens
acactgcaaccttgaggtctggtattgtggctctccagtccttgattcctgctgagattatgcaatttgccaagagcttgcctggtgtggagcagcactgatttctcacccctggaggctataactcatgtctctttttctcccattctagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagg

SEQ ID NO: 28494 - DNA, 784 bp, Homo sapiens
aaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagtcatttgcgaggagtcctttggtttccagttacctcccccacaggcgcacacgctggctgcttgcgttggcagcgacacacatccatgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatct

SEQ ID NO: 28495 - DNA, 4561 bp, Homo sapiens
ctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaa

SEQ ID NO: 28496 - DNA, 2693 bp, Homo sapiens
acttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctg

SEQ ID NO: 28497 - DNA, 1217 bp, Homo sapiens
agctgcctggcgggcgacccagccccatcctgatggccccaggacacaagcccaggagcgccccggtgcgcgcggttccgcggcccaggggcgccgggtttggtggcacagcgagccccctttctctagcgaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtgctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacacca

SEQ ID NO: 28498 - DNA, 3722 bp, Homo sapiens
ggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttc

SEQ ID NO: 28499 - DNA, 726 bp, Homo sapiens
tttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttcta

SEQ ID NO: 28500 - DNA, 2880 bp, Homo sapiens
agagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactattt

SEQ ID NO: 28501 - DNA, 1737 bp, Homo sapiens
cttaggaaaactcgacaggatattgaggggaggctccagccctcgggagtaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 28502 - DNA, 1927 bp, Homo sapiens
atggggtggagctgaggcccggggcgacctgccctggcctgccgtgggaggccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactatgtactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 28503 - DNA, 2873 bp, Homo sapiens
cggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 28504 - DNA, 2049 bp, Homo sapiens
ttctatttgcccagagcttttgtccagaaactctctgtcctgagaggtgattaaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctaaaaagttcagatcctattccttcccttttgacattattgggatgatgctcccgaaaagtcaaatttgacatcaagtatgcaaaagtgaacacagtaagatgcaatcaggcaaaacaaactcaaaaaatagctaatgaaatgaaaaaactgggcgaatgcatcatgttagtagaggaggaaaacttttgacaaggaaaaaccaggaaacaaacacatacattaacacaatgttacctcactaataatctcttttttaagttcagtaggtatttggttttaacacaaggcgcccccaaaactgggtacagcaaactactgccaaaatgagtcgtttcccaattcaaagaaaaatgttcaaatacctagaattcacaaatttcaaattgtctctaataaaatttaaacattttgcatatc

SEQ ID NO: 28505 - DNA, 3777 bp, Homo sapiens
ttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactattcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggtttctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatctttaacaccaaaactgaattcttatgcagaatttcctagcccatagatgacaacctgactttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttctgtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgttttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgt

SEQ ID NO: 28506 - DNA, 2127 bp, Homo sapiens
acaggccgagctcgcgggcgactgcctgccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagc

SEQ ID NO: 28507 - DNA, 1763 bp, Homo sapiens
gctgcgcggtggctgtggcaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaagcttg

SEQ ID NO: 28508 - DNA, 1893 bp, Homo sapiens
gacgctgcagctaagctgcgcggtggctgtggcagctcctgtactttgcctctcccaccccactggttttcctgcctccctcttcagaggtaagacacatggctggaccaaggcctccaggggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaa

SEQ ID NO: 28509 - DNA, 1862 bp, Homo sapiens
acaggccgagctcgcgggcgactgcctgccaggcagacgctgcagctaagctgcgcggtggctgtggcaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgccc

SEQ ID NO: 28510 - DNA, 1167 bp, Homo sapiens
ggggcggggccctgacaggccgagctcgcgggcgactgcctgccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaagggg

SEQ ID NO: 28511 - DNA, 1790 bp, Homo sapiens
acccggggggccgcgctgcgcggagtgccaggctgcgggcggctgcagacctgggagcggagaccggcccgccgcccccgacgccgccgagcacgtcagcggcgcgcagccggggctcggagaccgacgggcagaacgacgggcggcgactgcggcgaccgcgggacggcgagaggcacgcggcgggaggggaccggaatccgcagctccggccgcgccatggacggcaacgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtttccctgtggtctctgctagtgactctggtggtccttttcataatgaccggcactatgttaggacctgaactgctggcaagtatccctgcagctgtttatgtgatagcaatttttatgcctttggcaggctacgcttcaggttatggtttagctactctcttccatcttccacccaactgcaagaggactgtatgtctggaaacaggtagtcagaatgtgcagctctgtacagccattctaaaactggcctttccaccgcaattcataggaagcatgtacatgtttcctttgctgtatgcacttttccagtctgcagaagcggggatttttgttttaatctataaaatgtatggaagtgaaatgttgcacaagcgagatcctctagatgaagatgaagatacagatatttcttataaaaaactaaaagaagaggaaatggcagacacttcctatggcacagtgaaagcagaaaatataataatgatggaaaccgctcagacttctctctaaatgtggagatacacaggagcttctatcttgctgaaatattgcttcatatttatagcctgtggtagtgcacatggttaacataaaagataacactggttcacatcatacatgtaacaattctgatctttttaaggttcactggtgtattaaccaaacgttgtcacaaattacaaatcaatgctgtaatataatttgcacctggaatggctaacgtgaagcctgaattaaatgtggtttttagtttttaccatcaccaa

SEQ ID NO: 28512 - DNA, 1502 bp, Homo sapiens
ttaggatgaatcaccttgctggccaacagttattggaatgattctccatgtgtgacttcgttgcactattacaaaatgtggcaggatagacctgcccagccattgttgccgatgttcatttgtaatgctgccttaaggagatgaggagatgagagccaattgttccagcagctcagcctgccctgccaacagttcagaggaggagctgccagtgggactggaggtgcatggaaacctggagctcgttttcacagtggtgtccactgtgatgatggggctgctcatgttctctttgggatgttccgtggagatccggaagctgtggtcgcacatcaggagaccctggggcattgctgtgggactgctctgccagtttgggctcatgccttttacagcttatctcctggccattagcttttctctgaagccagtccaagctattgctgttctcatcatgggctgctgcccggggggcaccatctctaacattttcaccttctgggttgatggagatatggatctcagcatcagtatgacaacctgttccaccgtggccgccctgggaatgatgccactctgcatttatctctacacctggtcctggagtcttcagcagaatctcaccattccttatcagaacataggaattacccttgtgtgcctgaccattcctgtggcctttggtgtctatgtgaattacagatggccaaaacaatccaaaatcattctcaagattggggccgttgttggtggggtcctccttctggtggtcgcagttgctggtgtggtcctggcgaaaggatcttggaattcagacatcacccttctgaccatcagtttcatctttcctttgattggccatgtcacgggttttctgctggcactttttacccaccagtcttggcaaaggtgcaggacaatttccttagaaactggagctcagaatattcagatgtgcatcaccatgctccagttatctttcactgctgagcacttggtccagatgttgagtttcccactggcctatggactcttccagctgatagatggatttcttattgttgcagcatatcagacgtacaagaggagattgaagaacaaacatggaaaaaagaactcaggttgcacagaagtctgccatacgaggaaatcgacttcttccagagagaccaatgccttcttggaggtgaatgaagaaggtgccatcactcctgggccaccagggccaatggattgccacagggctctcgagccagttggccacatcacttcatgtgaatagcagggactagctggctggactggcccccttctttttcagtggccagtaaagacagtgtgcagctgacacatgaatcttgttggtagggccagtgtgaatatttaagtgttcaatgttagaatatttatattttcatgtggattgtgaattgtgatgggatcacttttggagattcccatttcagggagtttcttctgggggttaacataacgtatcaatg

SEQ ID NO: 28513 - DNA, 3852 bp, Homo sapiens
acagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaagga

SEQ ID NO: 28514 - DNA, 2136 bp, Homo sapiens
gatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaagtcggagtctcgctccgtcgcccagtcaggagtgcaatggtgcgatgtcagctcactgcaacctctacctcccaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaa

SEQ ID NO: 28515 - DNA, 2043 bp, Homo sapiens
ggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaagtcggagtctcgctccgtcgcccagtcaggagtgcaatggtgcgatgtcagctcactgcaacctctacctcccaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttggg

SEQ ID NO: 28516 - DNA, 5989 bp, Homo sapiens
gagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattata

SEQ ID NO: 28517 - DNA, 1549 bp, Homo sapiens
gtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagctt

SEQ ID NO: 28518 - DNA, 6041 bp, Homo sapiens
ctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 28519 - DNA, 1105 bp, Homo sapiens
tcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggacc

SEQ ID NO: 28520 - DNA, 3869 bp, Homo sapiens
gcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 28521 - DNA, 3644 bp, Homo sapiens
ggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggc

SEQ ID NO: 28522 - DNA, 4670 bp, Homo sapiens
cccggggggcgggcggaggaagtgagcgcagcggggaggaatgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 28523 - DNA, 4644 bp, Homo sapiens
agtgcatggtggggtagccagccggccacctttgggccatggcagccgaaggtgctgtgtgcggcttcgtctatctggagggcactgcctgggcggtccctgaggacaccgaacccttggcatcctgcacattgggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 28524 - DNA, 4635 bp, Homo sapiens
gagtcctgctagatccccgcaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 28525 - DNA, 3817 bp, Homo sapiens
ggatcacagtctgaaacgacagcaaggaagaggtaggcagggaaaactaactggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatgaaccagacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactag

SEQ ID NO: 28526 - DNA, 4568 bp, Homo sapiens
gcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagttcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 28527 - DNA, 4096 bp, Homo sapiens
tgcactcggtcaccgcgggctgcggcggctgggcggggctttcgggcgcccgcgggacggttccgccctctcactgcacccccgggcttctcttcgcaaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 28528 - DNA, 4194 bp, Homo sapiens
tgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 28529 - DNA, 3660 bp, Homo sapiens
tttcagacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatcc

SEQ ID NO: 28530 - DNA, 4425 bp, Homo sapiens
agctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 28531 - DNA, 3866 bp, Homo sapiens
tgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataa

SEQ ID NO: 28532 - DNA, 3725 bp, Homo sapiens
actcggtcaccgcgggctgcggcggctgggcggggctttcgggcgcccgcgggacggttccgccctctcactgcacccccgggcttctcttcgcaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctccca

SEQ ID NO: 28533 - DNA, 548 bp, Homo sapiens
atcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattc

SEQ ID NO: 28534 - DNA, 3744 bp, Homo sapiens
agttacctagcaaacaatcttcatgttaagactgagctcaaataccacttcttccttaatggtccctgtgatcactccaggaaatgtaatacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatcc

SEQ ID NO: 28535 - DNA, 4239 bp, Homo sapiens
tgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 28536 - DNA, 567 bp, Homo sapiens
actcggtcaccgcgggctgcggcggctgggcggggctttcgggcgcccgcgggacggttccgccctctcactgcacccccgggcttctcttcgcaagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaa

SEQ ID NO: 28537 - DNA, 5272 bp, Homo sapiens
agcgcgggccgggccgggacggggactgtcggctgcaggcggccatgcccaccaacttcaccgtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcgcactgccctacgtgctcaccgacatcgcggcctccttcaccctgctggttggcatctacttcccttccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagagcctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtggacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatctggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccgcccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 28538 - DNA, 867 bp, Homo sapiens
gtggcgtcggcgggagcggcgcagcgcgggccgggccgggacggggactgtcggctgcaggcggccatgcccaccaacttcaccgtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacaggcacggaggacggcgtgggcagcctgggcctgggcttggcccagggaaacagacggcagacacacctgtcccccagtgatgccgcccaagctgcccatggggcttcctacggaagtttctag

SEQ ID NO: 28539 - DNA, 4208 bp, Homo sapiens
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaa

SEQ ID NO: 28540 - DNA, 3119 bp, Homo sapiens
ctggcccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaa

SEQ ID NO: 28541 - DNA, 4235 bp, Homo sapiens
tccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggca

SEQ ID NO: 28542 - DNA, 5562 bp, Homo sapiens
ctggcccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggcatggccacctttctgttgtgccttgcatttgtccacacacagggagtctggctgagctggggaaaggccacggctgggtgtcattgccattttcccagctcatctcaccgggaagaaaagcagattgacagaacacgtgaggaggggtattgatggcaggagagtcaaaaaagagttttaaagaaggggcaaggttgaaggagtctagtggcaagggtaagatttcaggcatggttaagaacagacgacaaggatgtcaggaatgaagatgtggagaggggtgtagagatggcaaggttggcaaggaacagataggcaggagcaggtccaagccaagcctagcccaagaccaggtgaaaggagaggggaggaggagccacctgcaagagatggaaagagcaggcggcagagggggctggcagggaggggctgttaagagtggggttggaggtgggagagaagctaggacaagggagatggagaaaggacctatacctggctcacggaaggccttcaggtcactacacgttgaacatccccagtgtttgagcccccaaagctagggtgcaagagcactgccatcgaatgccagtgggtgaggccaagtgagggtatttgcagctctagacataaccaagaagcgtaaaggtgagttgtttggtggtacgactgcctgtgccttcttccgatggcactggggtggctgaaggaacagacatctttgggtttcatcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattcagtcaacgg

SEQ ID NO: 28543 - DNA, 1764 bp, Homo sapiens
ctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggcactgaggaaacaaggagcttcacctctccctcaaggagctcagagtcgaaggaggagacagacttcccttatatgaattagaacaagcaagagtagaatcaagtgcaaaggaaagaggaagcagaaattgcctgtcccctcaaaaagtaaaggaagactttcagaagaggggacactcaatccaggttttgagggatgaacaggagtttgccgacaggacaaagaagagacggacatttgaaacagaaggaatgggatgtaagaaggcaccaagaaagatgctgctaatgagaattattttaagtgcagagtagtgtatgtaatccttcattaatatattaataaacatatttataaataa

SEQ ID NO: 28544 - DNA, 4707 bp, Homo sapiens
tacatttcctcagaagaaggctccttggtgctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagaggatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatgaaaaccaccaatgtgattgtaaacttctccagacaaacttaaccttttgtttcttaattttttgttttgagtgtttgcttctcagccctggtataggtctcagccccacagcaggatctcaataaatgcttattgacaggctggcatagtaaccacaggtggttatcaaaggaaaagaccaataggctggggaacataattatgcttggccccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgattttctgatgaatggcttgatttttctccttgacatgttttgactgttcattctaactgaaaacatatatgggaaaatatgaacctgaaataaaagcactcaaattc

SEQ ID NO: 28545 - DNA, 4708 bp, Homo sapiens
acatttcctcagaagaaggctccttggtgctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagtcatcatcattggcctaagtgtggtagtaacgacactcacaggtatttctatgtctgctatttgcacgaatggagtagtaagaggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagaggatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatgaaaaccaccaatgtgattgtaaacttctccagacaaacttaaccttttgtttcttaattttttgttttgagtgtttgcttctcagccctggtataggtctcagccccacagcaggatctcaataaatgcttattgacaggctggcatagtaaccacaggtggttatcaaaggaaaagaccaataggctggggaacataattatgcttggccccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgattttctgatgaatggcttgatttttctccttgacatgttttgactgttcattctaactgaaaacatatatgggaaaatatgaacctgaaataaaagcactcaaattcaa

SEQ ID NO: 28546 - DNA, 2174 bp, Homo sapiens
gttactgaaccgatcagcgaacacagacaaacgtgccaacacttaagtctactggctggacttcatctccatggcaacaagcatggaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaaca

SEQ ID NO: 28547 - DNA, 2673 bp, Homo sapiens
atgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaacaagctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagaggatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatgaaaaccaccaatgtgattgtaaacttctccagacaaacttaaccttttgtttcttaattttttgttttgagtgtttgcttctcagccctggtataggtctcagccccacagcaggatctcaataaatgcttattgacaggctggcatagtaaccacaggtggttatcaaaggaaaagaccaataggctggggaacataattatgcttggccccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgattttctgatgaatggcttgatttttctccttgacatgttttgactgttcattctaactgaaaacatatatgggaaaatatgaacctgaaataaaagcactcaaattc

SEQ ID NO: 28548 - DNA, 3426 bp, Homo sapiens
atcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagagga

SEQ ID NO: 28549 - DNA, 2176 bp, Homo sapiens
gttactgaaccgatcagcgaacacagacaaacgtgccaacacttaagtctactggctggacttcatctccatggcaacaagcatggaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaaca

SEQ ID NO: 28550 - DNA, 6885 bp, Homo sapiens
acactcgcgcgctcgctcggctgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtcca

SEQ ID NO: 28551 - DNA, 5509 bp, Homo sapiens
tctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgca

SEQ ID NO: 28552 - DNA, 3815 bp, Homo sapiens
tttatttggaggacactattgaagccacctgctcaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaaaaagaaggaaaaaagaataagaatgaaaactgctgacgtattacaaaacagaaaaataaatgatttaaaatcaaatcaaaaagaaaaaactaaacatttaaacaaaaatgggataagaatagtcttctagaagtgaggatgcgaaaaagaatgagtttccaattaccctgatgtgacaattacacattgtagacaggtagcaaaatatcacatacacccccaaaatatgtacaaatattatatatcaataaataaatttttaaagagtaagtgctattggcattccaaaattcagctaaaggaaaaatgatcaaaaacaaagtaaggtgcacagttagcaaaagatgcagatgttatatcacagcaattctcatgctaaaaatacaacaaaagacaaagcaaaaaataaacctttgcttttttttttttttttttttttttgagacggagtctcgctctgtcgcccaggctggagtgcagtggcgggatctcggctcactgcaagctccgcctcccaggttcacgccattctcctgcctcagccaaacctttgctatttttaatcttcgttggcactttccagctgttactgaccttgtcattttttattcaaataagattatttacaaacttattcttgaaactaaatatagtaaagagggtttttaaaataatatttaacatacgaattattaattggccatgttcattatttatctatgtttattaatgggccaatgcaaaaaatcattttttcaaagaaaaatttgtccatgtaaagcttaaattataatattgctgctttgtataactcttctatgtttattctattcatttgttcctttccctaccatattttacacatgtatttataatctgtagtatttattacatttctgcttttttctagtcattcaatttatcactgctgaattgcatcagatcatggatgcatttttattatgaaaaaataaaatgacttttcaaattataa

SEQ ID NO: 28553 - DNA, 2222 bp, Homo sapiens
ccagcctcataatatcaccttttgctttgcatttgttcttaccaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagtacttgcaagtgaggtgaccaaaaaacagctttagactcttaaacttagtgtttaaaatgagaaggctgagagacagtctgcttatggagaaagttggagtatttccccagtgccccaaccccctgccacttgtaccatcacagtcgaaagaagggaagagtctcctacttaacaaggaagaggaagaatcaaaccaacaaagggtgtttacagggtcatgggtgagaaaaagaatgaagttgcttttggcttacaccctagaaagtcatctcttaaataaaacacttacatttggactagtgattccccaagtgaaaccatttcaggatgtgccattgtccaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacc

SEQ ID NO: 28554 - DNA, 2897 bp, Homo sapiens
ctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctttacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggagccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagagtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctgtctgaaacgctgcacattaaccccctctacaccctgatcccagtcaccatgtgcatctcctttgcagtgatgctgcctgtgggcaatccccctaatgccatcgtcttcagctatgggcactgccagatcaaagatatggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaa

SEQ ID NO: 28555 - DNA, 1723 bp, Homo sapiens
agctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgat

SEQ ID NO: 28556 - DNA, 3236 bp, Homo sapiens
tcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctcca

SEQ ID NO: 28557 - DNA, 1738 bp, Homo sapiens
actcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaa

SEQ ID NO: 28558 - DNA, 3145 bp, Homo sapiens
aatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaa

SEQ ID NO: 28559 - DNA, 2711 bp, Homo sapiens
ggagaacagcagaaaggaaaggccgggccagcggaggtggcttgggggctgcctgtggagggtggctgggggactctccttccttctccagctcctccagcaccaccctcagcagcctccaagaacagaaggagttaacgctgggattaacttcttgaaggaacctgaagttttttaatccttgttctttcctccttccttctccctctcccttcctgatctttactccgcctgtgggtccctcctccttactctcacctccccaactccaaaaacactctgattgccagactgggtcaatggttaacactcaactggctttatataagcctgccacctgcctgcttggctgcatctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagtaaa

SEQ ID NO: 28560 - DNA, 2502 bp, Homo sapiens
atctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgagatcattcagagaccatttccatccagtttcgagagcccaggggaatgccagtctgtgggaatgtcagtgactgcatcccataacctcgggggcaccgtgggagactccagggtcttcccgccgctcagccatgtctccacctgccaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagt

SEQ ID NO: 28561 - DNA, 2466 bp, Homo sapiens
gggcctatcgctcctacctgatcgtgttcttcgtgcccattctcctgctgcctctgcccatcctcgtccccagtaagctgtgaaatgtgaacaatagttattacctctgagagcaaataaatgcaacttgtaaaagcatttgaagcacatagaatatgacgcctggcacaaagtcatcctccaatacttatacagaaacttcttcctgaatcagcagagaggcctactgcgcgtatgccatcatcctcatggcgctcttctggtgcactgaggccctgcccctggccgtcactgccctcttccccttaatcctgttccctatgatgggcatcgtggatgcctctgagatcattcagagaccatttccatccagtttcgagagcccaggggaatgccagtctgtgggaatgttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagt

SEQ ID NO: 28562 - DNA, 1276 bp, Homo sapiens
atctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggctttttttggctggggcaatttggcttttcccaatgccaagggggagaggtgagagttgcaggggttgggaggaggacacatctggggctcacatgctcgggaaggagggaagggtatagggcccccattgcagaacaggaggtaacacttggtgggggatga

SEQ ID NO: 28563 - DNA, 2226 bp, Homo sapiens
atctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagt

SEQ ID NO: 28564 - DNA, 4017 bp, Homo sapiens
ccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttatt

SEQ ID NO: 28565 - DNA, 3993 bp, Homo sapiens
ggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaacctg

SEQ ID NO: 28566 - DNA, 737 bp, Homo sapiens
agtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacaggaatagaacccaatactttcctctctgaggaaaggctgaaacttcaagctccccttgtgataagacttggtcagataactgagtctggtcaatggaatatgagtggaaatgatgtgtgcaacttccgggttctgtccttcctgccgggtggaatgtga

SEQ ID NO: 28567 - DNA, 1055 bp, Homo sapiens
agtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagcaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctggatgcaaaatgggcattataagcatttcaacaatacagaaaatgtga

SEQ ID NO: 28568 - DNA, 3940 bp, Homo sapiens
agtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaacctg

SEQ ID NO: 28569 - DNA, 2008 bp, Homo sapiens
agtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagcaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcat

SEQ ID NO: 28570 - DNA, 876 bp, Homo sapiens
ggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacaggaatagaacccaatactttcctctctgaggaaaggctgaaacttcaagctccccttgtgataagacttggtcagataactgagtctggtcaatggaatatgagtggaaatgatgtgtgcaacttccgggttctgtccttcctgccgggtggaatgtgaatatgatggcacctgggacccaaagacaggagccacatcttgagagatagatggcagatctgcccctgtggctttggatcatttacctcagtgaacacaacaagcattatccatgaaaccataggttttgtgtgctagttctagtttttaaaatatgaattaaattaaatacgtatctgttaaaacttaaa

SEQ ID NO: 28571 - DNA, 3932 bp, Homo sapiens
agtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaacctg

SEQ ID NO: 28572 - DNA, 1597 bp, Homo sapiens
ttagccgggcatgatggcgggtgcctgtaatctcagctacttgggaggctgagataggagaatcgcttgaacccaggatgtggaggttgcagtgagccgagatcgccactgcactccagcctggacagggcactgggagtgtggcagggggcaattgggactcccttgttcccctggagtttaacctagtggtaaacactttcagacgacgaatcatgctatttggggattttgtacagggtgaggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagct

SEQ ID NO: 28573 - DNA, 1887 bp, Homo sapiens
actgctgccctgagaacaagccggggcaggccctgccgcaggcctccttccccctctgcccccagcccaggcctccttccccctctgccctgagccctgggcctccttccccttctgccccgagccccgctgaccctctgagcatgcatctcctcctgcaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctg

SEQ ID NO: 28574 - DNA, 3540 bp, Homo sapiens
gtaagctgcctccatcatcctaaaaaacgaccatgctgaaagagctcctctgtatttcttggcagaccctttccagttttcatcctgggtgtttctgaacaggaacatatctcattgaagtatttgcacctctacctacagacaaggaaaaggcttggagcacctccattcattgtgccaacaggacctgaatgaccgattgtttcttgcttactacttgtggtcaactaagtagagattcataagacctttatagaaccactgacaacactgtgaccaaggaaacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagt

SEQ ID NO: 28575 - DNA, 3971 bp, Homo sapiens
acacagagcagagtggggctctgagtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 28576 - DNA, 1390 bp, Homo sapiens
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatgg

SEQ ID NO: 28577 - DNA, 4129 bp, Homo sapiens
acacagagcagagtggggctctgagtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 28578 - DNA, 4226 bp, Homo sapiens
acgcagcagaacaaaatctgggcattggtccctgtgtaggatggcttcccgttattttttttttaagcaaagtaaatgaacatcaaatttccatagtcagctgctgtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 28579 - DNA, 1684 bp, Homo sapiens
gcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaa

SEQ ID NO: 28580 - DNA, 2371 bp, Homo sapiens
gcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctac

SEQ ID NO: 28581 - DNA, 1048 bp, Homo sapiens
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttcca

SEQ ID NO: 28582 - DNA, 4167 bp, Homo sapiens
ttttttttttttttttgagacacagtttgctctgtcacccaggctggagtacattggcactatcttggctcactgcaacctccacctcccaggttcaagagattcttctgtctcagcctcccagtagctaggactacaagtgtgtgccaccacaccctgctaatttttgtatttttagtagagacagggtttcaccacattggccaggctggtctcgaacttctgacgtcaagtgatccacccgactcggcctctcaaagtgctgggattacaggcgtgggccgccgcacccggccatttgcttttgattttactggctcataggtggaagggacttgccttgcctcagatgaaactttggactttgactttcaagttaatactggaataagttaagactttgggggactgttgctaaggcacaattttgttttgaaatgtataaagaacataatatctgggaggggccaggggcagaatgatatggtttggctctgtgtccacacctgaatatcatctcaaattgtaatcccagtaatccccatatgttgagggcaggacccagggcaaggtgactggatcatgggagcggtttcccccatgctgttctcgtgatagtgagtgaattctcacaagatctgatggttttataagtgtttggcaagttcctgctccacaccatctctctcttctgccgccatttgagaaggtccaagtttgcttccccttcgccttccaccatgactgtaagtttcctgaggcctccccagcaatgtggaagttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagtcccagctacttgggaggctgaggcaggagaatggcgtgaacccgggaggtggagcttgcagtgagccaagatcacgccactgcactccagcctgggcaacggagtgagactctgtctcaaaaaaaaaaaaaa

SEQ ID NO: 28583 - DNA, 1729 bp, Homo sapiens
atctctctcttctgccgccatttgagaaggtccaagtttgcttccccttcgccttccaccatgacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctggatggagacggattttaactggagtaagagtggatgctggaagcatctgctacaataatccacaattgtctgctacaaaaccccacagagatgacagtgtttagattagagtgatatccatgaacatgccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggtgaatagccatgttcggggaagaaacgctctttgcctgacctgatgtcctctccctgtgttctctgctctggttcaatcagttgcagcactcaccttctttgcctctccttgcacctgtgtagaaccaagcacacctgtaactttctttccctgaagctgattttcattctctgccagaatctccataactatctattgtgcgacattaagggatgttggtattacagtaaaatttccggagttagc

SEQ ID NO: 28584 - DNA, 1619 bp, Homo sapiens
cagtcaccggtaagttactgaatctgcgttggctgcctttcatgccactggtgctcctttgtggctatggaccagtggggggtgtatttcaatcctgtgcttgtttctttttgtcagagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagaggtaagagatacctgaaaggaacttctgttggtcttttttagtaaggccaagtccgtgtcttcttcgttttgttctgttcttcccttctgccctgttttctagctgtcagctacatgctgggatgcacgttggaatctggagtaagtgcttccttccctgtgagtttcacctcctttttgtcttatttaaatcccttatcccagtgaccactggagagtctaagccatccttagcatgggcatccatcttcctaaactgttattcatgcaaagtcatgctcgtggtaagaggtaagaggcaagagaggtgccttggaagccaagctggtggccgtagctgccattttagccttcaagctttgctccccagtgatatttctgtgacttaggaagagtttactgggcaaaattgtattgattttttgtttgttttgttttgtttttagaaggagtcttgctctgtcacccacgctggagcgcagtggcgtgatcttggctcactgcaacctccacctcctgggttcaagcaattctcctgcctcagcctcctgagtagctgggacaacaggcgcctgccaccatgcccggataatattttttgtatttttagtagagatgggatttcaccatgttagccaggatggtctcgatctcctgccctcgtgatctgcctgccttggcctcccaaagtgctgggattacaggtgtgagccaccacgcctggctaaggcaaagtttttttctttgctttcccatcatctcaagtatttccaaaagaactgctcagataaagagaatgggacagtgtcagtaactatcagaggtttgtgcttgctaatgctccatagagagtttgtgaatttcccatgtggaagggaatatgtggtgttactggtgacaaactaacaagaccatcctgtccacatttgaatcagattagattatgaaataaagatttcagggggatt

SEQ ID NO: 28585 - DNA, 1621 bp, Homo sapiens
cagtcaccggtaagttactgaatctgcgttggctgcctttcatgccactggtgctcctttgtggctatggaccagtggggggtgtatttcaatcctgtgcttgtttcttttttgtcagagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagaggtaagagatacctgaaaggaacttctgttggtctttttttagtaaggccaagtccgtgtcttcttcgttttgttctgttcttcccttctgccctgttttctagctgtcagctacatgctgggatgcacgttggaatctggagtaagtgcttccttccctgtgagtttcacctcctttttgtcttatttaaatcccttatcccagtgaccactggagagtctaagccatccttagcatgggcatccatcttcctaaactgttattcatgcaaagtcatgctcgtggtaagaggtaagaggcaagagaggtgccttggaagccaagctggtggccgtagctgccattttagccttcaagctttgctccccagtgatatttctgtgacttaggaagagtttactgggcaaaattgtattgattttttgtttgttttgttttgtttttagaaggagtcttgctctgtcacccacgctggagcgcagtggcgtgatcttggctcactgcaacctccacctcctgggttcaagcaattctcctgcctcagcctcctgagtagctgggacaacaggcgcctgccaccatgcccggataatattttttgtatttttagtagagatgggatttcaccatgttagccaggatggtctcgatctcctgccctcgtgatctgcctgccttggcctcccaaagtgctgggattacaggtgtgagccaccacgcctggctaaggcaaagtttttttctttgctttcccatcatctcaagtatttccaaaagaactgctcagataaagagaatgggacagtgtcagtaactatcagaggtttgtgcttgctaatgctccatagagagtttgtgaatttcccatgtggaagggaatatgtggtgttactggtgacaaactaacaagaccatcctgtccacatttgaatcagattagattatgaaataaagatttcagggggatt

SEQ ID NO: 28586 - DNA, 2263 bp, Homo sapiens
cacctgccaggagcacgtcccgccggcaggtcgcaggagccctgggagccgccgccatgggaatgtccaaatcacacagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctacaatgccagcacataccagttttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattgg

SEQ ID NO: 28587 - DNA, 3910 bp, Homo sapiens
agagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagtataaa

SEQ ID NO: 28588 - DNA, 865 bp, Homo sapiens
tccacgtggccgaggtgcacaccccaacccactgggccagtctccccaccctcttacctgctcttctttcccgactcgtctttaatacccaccaggcgccaaccgccgcgggcctggctctatggtggcaagttgcatgggttctcccatcaggacctcccgatgagcctacgagatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgaga

SEQ ID NO: 28589 - DNA, 3117 bp, Homo sapiens
acggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaagatactttaaaggatacatgtgaaagccagatgaagaagtacatagggcaaagtctggaagggtccccaagtacaggagcctcttcccccgtggaattggggtatgctatcctccctgcacatggatgcaatgaccaacctggaatctcatcagatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtatagtatatctccctactaatgtgggtctattacaaaacaagcatgtaagatgggaatgctgacagaaagcaaacattagtgagctatttgggtaagaataaatctttctcatttatgtacccttgatgctgggacaatgcttggcacagcataattgctcaaatatagaatctaattaaatggaaccatcaaggcaaaagggggatcaaatattgttacaaatgtcagtgttttttctttttttttgagatggagtcttgctctgttgcccaggctggagtgcagtggcaccatctcagctcactgcaacctccgcctcccaggttcaagcgattcccctgcctcagcctcccggtagctgggattacagatgcatgccaccatgcctggccaatttttatatctttaatagagacagggtttcgccatgttggccaggctggtctctaactcctgacctcaaacgatccacttgtctcagcctcccaaagtgctgggtaacaggtgtgagccactgtgcctggcctaaaatatgtttttttctgatcgcaaaactgatgtgcttagtgtagaaaagcatgtagaaaaacaacccaatctttaaagcgctagtgattatttcattttaaaaatgaagtatatttcacataagttttttttttttttttttttttttttaagacagtcttggtcttgttgcccaggctggagtgcaatggcgcgatctcggctcactgcaacctctgcctcctgggttcaagcaattctcctgcctcagcctcccaagtagctgtgattacaggcgcccaccaccatgcccagctaatttttgtatttttagtagagacggtttcaccatgttggccaggctcgtcttgaactcctaacctcaggtggtccacccgccttggcctcccaaagtgctgggattacaggcatgagccaccatgcctgatccataaatttttt

SEQ ID NO: 28590 - DNA, 1099 bp, Homo sapiens
tccagaatgaagttcagagaaacaaaggaatgaatgataacatgacaacatagaagggagagtaagagagtagatagcatgggaaggtccaacccatatccagttggagtctgagaaaagtgaaaagagagaatgggggagaagcaatatttgaagacataatagatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaa

SEQ ID NO: 28591 - DNA, 2201 bp, Homo sapiens
gctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaaatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagc

SEQ ID NO: 28592 - DNA, 4374 bp, Homo sapiens
gctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaaatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagt

SEQ ID NO: 28593 - DNA, 2799 bp, Homo sapiens
ttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatctcaacatctgctgcaatttgactgttcagatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaatctacattttgaccatactaccctttcatgtccttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaaa

SEQ ID NO: 28594 - DNA, 3430 bp, Homo sapiens
gcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaatctacattttgaccatactaccctttcatgtccttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaaa

SEQ ID NO: 28595 - DNA, 1153 bp, Homo sapiens
gcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataa

SEQ ID NO: 28596 - DNA, 909 bp, Homo sapiens
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataattaatgtctagactggggttggtgcctcacgcctgtaatcccaccactttggggggctgatgcaggagttcaagaccagcgtgggcaacataaggagacttcatccctacctggggaaggaaaaaaaaaaaagaaggaagaagcagtgtctaaagtatctgcccctggcaacgtttgttcaaaagtgttcattatgtttcttccttttttcttttgtggctgaaaatgtatttacaattcaccgtaaatgataaaaatggcattggcacacata

SEQ ID NO: 28597 - DNA, 646 bp, Homo sapiens
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactgatcatgaatattactatttaataaaga

SEQ ID NO: 28598 - DNA, 1231 bp, Homo sapiens
agtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaattttcaattttgccatcttcaaggtgacagcttatgcagtgtgggcagttggaataccacttgcactttttggatactttgtgccttatgttcacttggtgagtatgctccttcactgatcatgaatattactatttaa

SEQ ID NO: 28599 - DNA, 4622 bp, Homo sapiens
tcagtctcgccggcggcccccgctcccggatccccagcgccctggccaagaagcttcctcggctccccctcttccctctccctgacacggttgtgcagagggcgcggtggctcagatacaggatttcgacatattggccggtttgctctcgagctcctgggctcaagcgatctgcccgctttagcctcccaaagtgatgggattacaggcgtgagccaccgtgcctggccataatttttaaaaatgtctagtcagatggcgagtaacccatgggccaggtagcgttctatgccaaccttgaatgccatcaggaagtcactggacagcaaactcttccaagatcataacttggctgttggagcaacctggaaaagaagaaaaaagaaaaaccatggcaaaagtaaatagagctcggtctacctcccctccagatggaggctggggctggatgattgtggctggctgtttccttgttaccatctgcacacgggcagtcacaagatgtatctcaattttttttgtggagttccagacatacttcactcaggattacgcacaaacggcatggatccattccattgtagattgtgtgaccatgctctgtgctccacttgggagtgttgtcagtaaccatttatcctgtcaagtgggaatcatgctgggtggcttgcttgcatctactggactcatcctgagctcatttgccacgagtctgaagcatctctacctcactctgggagttcttacaggtcttggatttgcactttgttactctccagctattgccatggttggcaagtacttcagcagacggaaagcccttgcttatggtatcgccatgtcaggaagtggcattggcaccttcatcctggctcctgtggttcagctccttattgaacagttttcctggcggggagccttactcattcttgggggctttgtcttgaatctctgtgtatgtggtgccttgatgaggccaattactcttaaagaggaccacacaactccagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaaggtgtctgaagaattaccagtatgtttgctacctctttgccgtgggaatggatgggctctgctatctctgcctcccaatgcttcaaagtctccctctgctcgtgcctttctcttgtacctttggctactttgatggtgcctatgtgactttgatcccagtagtgaccacagagatagtggggaccacctctttgtcatcagcgcttggtgtggtatacttccttcacgcagtgccatacttggtgagcccacccatcgcaggacggctggtagataccaccggcagctacactgcagcattcctcctctgtggattttcaatgatatttagttctgtgttgcttggctttgctagacttataaagagaatgagaaaaacccagttgcagttcattgccaaagaatctgatcctaagctgcagctatggaccaatggatcagtggcttattctgtggcaagagaattagatcagaaacatggggagcctgtggctacagcagtgcctggctacagcctcacatgaccaaaggccttgagccccagaatcttcaggtttgagagaggtggggccaccagattcttcatgtttctgaaactttttattttggcagaaggattgccttccaaggaaattattattattgttttgttaacatattaatatttataagggaaaacagcacataataaggaaagctggactagcccagagccttctcatttgggatttgtgctcataactgaactcgtatcttttggtcaatgggcatagctctgtaagaaatgtaaggacacagctgatataattagctgtaattagggataatttcaaagcataaccaaagcagatgacactgggcagcagctttgttccagtctcaggcccttcatgttccctcctcagaaagaaaatggaaacattaacgtgtagctttgcttaccttgttctggttagagaagggaggtcagcttgggtgtggtggtgaagagtgaagatgccatactttttcatggtggagtttctcattagggttttacttgggattgttaaagaatacttgagattcttcaaaaagtggtgattaatatagaaagaaactcttattttttttttctcttagtcttccagccagcccttgcctctgcccaagggtagacaccactatgagaatccaaataatcatggaatgccatggttggaatagatcttaaagggcatctggtaagatccatttgaaattgtccactggaaaccgaaagctcttttcctaagactgggttccaggctctcacatttgttaccatcacatataatacttactctaaatttagcagaacacacttagtcacaaggacaacctctcaatcttacctgaaatgtcaacaacaccaaaacttcccgtcttttaccttcagagaagaagctcttacttagactgcagacgcattcctgttaggttggaaaaatgttggcagtattccaattgggcaggaactgaattcttgaatcagcaggtctctggtgagagttttctttgcagatcagacatttagttttatcattacccaaaagaggattggagggagtcagttgtctgaaaaatattatcctagagatattctaaaggtgagattcctttctccctgtgttaattcttgttccactatccactgctcttcatctctttatagataataattagaaatctactcattggattataagtttattcattctcaaatactccacttttctatggtttgggataatttctgagtcttcagattgaagagggaaggcatggagggaagaaaaagtccagatcccccagcttgtttccaaccattttaagtccaaagaattataatcctgaatctcacagtgtgtcacacctgtaataggagtaaattatgcaatcaattttaattaccaggagtttaaaatccaaatgtcaaggaactgttttgaccctgaaggctatttaatccactgtcccctacaaggcctcacaagtgctgggggaaaaaaaacagcaatgaggatgatcctgagttaatgtgtatgctccgcaagagagcttgcctataccttgattatttcataaaatcacatgttaatacattgctttcagaatgaaatactgacttgatctgataggagaaaatggtaatatttcatagttgttttccaaagacaaatttaaatgttgtctgttatctccttacttagtttaagaatttagttttgaaccccattgactttgtcatttgcaattttaaaaatatttgggactgggcatggtcgctcacgcctgtaatcccagcactttgggaggctgaggcgggtggatcatgaggtcaggagatcaagaccatcctggctaacatcgtgaaactccgtctctactaaaaatgcaaaaaattagccaggcgtggtggcgggcgcctgtagtcccagctactcatgaggctgaggccggacaatcgcttgaacccaggaggtggaggttgcagtgagccaaaatcatgccactgcactccaccctgggcgacagagcaagactccatctcaaaaaaaaaaaattggaaggtatctgtaaaatgtcaaagttaagatgaagttatatctgtttggaatagcactttgccctaaatatcatttcttgaattttcaagcctaaagatgtttaaaaatatgaatagttacaaatattcttatacatattttttatcatgatcacaacaaaattttgtttatgtggttctgcaatataatttctgtgaagtattacaagtatttatgaaaaataagcatagtgatcagaaattttaaagattttgtataaaaacatttgggagatttgactttatacatgcatagatttgcattttactttcccttttgaggcagcatttttagaaaatcagtaagaaaaatgtacatcttaaggtctactattttacatttctacacagaattttagtgttaatgttccatgtgtctatactgtttatttcaaaactgagaaattcatgggaatgatgtattttgtggaatcaagaacaaaattatagtgggataattttacatcttaaatatttctttctactactgtaagctctactttggaattatctgagtagaaaatcagaagacattatctaactttgtagatacactgtatgattgggctttttgttcagattgtaatttcattaatagatgaaatatttatgctaatattttcttatttcaaaagcaaaataaaatgaatttattgtcctgtgtttgg

SEQ ID NO: 28600 - DNA, 4617 bp, Homo sapiens
tcagtctcgccggcggcccccgctcccggatccccagcgccctggccaagaagcttcctcggctccccctcttccctctccctgacacggttgtgcagagggcgcggtggctcagatacaggatttcgacatattggccggtttgctctcgagctcctgggctcaagcgatctgcccgctttagcctcccaaagtgatgggattacaggcgtgagccaccgtgcctggccataatttttaaaaatgtctagtcagatggcgagtaacccatgggccaggtagcgttctatgccaaccttgaatgccatcaggaagtcactggacagcaaactcttccaagatcataacttggctgttggagcaacctggaaaagaagaaaaaagaaaaaccatggcaaaagtaaatagagctcggtctacctcccctccagatggaggctggggctggatgattgtggctggctgtttccttgttaccatctgcacacgggcagtcacaagatgtatctcaattttttttgtggagttccagacatacttcactcaggattacgcacaaacggcatggatccattccattgtagattgtgtgaccatgctctgtgctccacttgggagtgttgtcagtaaccatttatcctgtcaagtgggaatcatgctgggtggcttgcttgcatctactggactcatcctgagctcatttgccacgagtctgaagcatctctacctcactctgggagttcttacaggtcttggatttgcactttgttactctccagctattgccatggttggcaagtacttcagcagacggaaagcccttgcttatggtatcgccatgtcaggaagtggcattggcaccttcatcctggctcctgtggttcagctccttattgaacagttttcctggcggggagccttactcattcttgggggctttgtcttgaatctctgtgtatgtggtgccttgatgaggccaattactcttaaagaggaccacacaactccagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaaggtgtctgaagaattaccagtatgtttgctacctctttgccgtgggaatggatgggctctgctatctctgcctcccaatgcttcaaagtctccctctgctcgtgcctttctcttgtacctttggctactttgatggtgcctatgtgactttgatcccagtagtgaccacagagatagtggggaccacctctttgtcatcagcgcttggtgtggtatacttccttcacgcagtgccatacttggtgagcccacccatcgcaggacggctggtagataccaccggcagctacactgcagcattcctcctctgtggattttcaatgatatttagttctgtgttgcttggctttgctagacttataaagagaatgagaaaaacccagttgcagttcattgccaaagaatctgatcctaagctgcagctatggaccaatggatcagtggcttattctgtggcaagagaattagatcagaaacatggggagcctgtggctacagcagtgcctggctacagcctcacatgaccaaaggccttgagccccagaatcttcaggtttgagagaggtggggccaccagattcttcatgtttctgaaactttttattttggcagaaggattgccttccaaggaaattattattattgttttgttaacatattaatatttataagggaaaacagcacataataaggaaagctggactagcccagagccttctcatttgggatttgtgctcataactgaactcgtatcttttggtcaatgggcatagctctgtaagaaatgtaaggacacagctgatataattagctgtaattagggataatttcaaagcataaccaaagcagatgacactgggcagcagctttgttccagtctcaggcccttcatgttccctcctcagaaagaaaatggaaacattaacgtgtagctttgcttaccttgttctggttagagaagggaggtcagcttgggtgtggtggtgaagagtgaagatgccatactttttcatggtggagtttctcattagggttttacttgggattgttaaagaatacttgagattcttcaaaaagtggtgattaatatagaaagaaactcttattttttttttctcttagtcttccagccagcccttgcctctgcccaagggtagacaccactatgagaatccaaataatcatggaatgccatggttggaatagatcttaaagggcatctggtaagatccatttgaaattgtccactggaaaccgaaagctcttttcctaagactgggttccaggctctcacatttgttaccatcacatataatacttactctaaatttagcagaacacacttagtcacaaggacaacctctcaatcttacctgaaatgtcaacaacaccaaaacttcccgtcttttaccttcagagaagaagctcttacttagactgcagacgcattcctgttaggttggaaaaatgttggcagtattccaattgggcaggaactgaattcttgaatcagcaggtctctggtgagagttttctttgcagatcagacatttagttttatcattacccaaaagaggattggagggagtcagttgtctgaaaaatattatcctagagatattctaaaggtgagattcctttctccctgtgttaattcttgttccactatccactgctcttcatctctttatagataataattagaaatctactcattggattataagtttattcattctcaaatactccacttttctatggtttgggataatttctgagtcttcagattgaagagggaaggcatggagggaagaaaaagtccagatcccccagcttgtttccaaccattttaagtccaaagaattataatcctgaatctcacagtgtgtcacacctgtaataggagtaaattatgcaatcaattttaattaccaggagtttaaaatccaaatgtcaaggaactgttttgaccctgaaggctatttaatccactgtcccctacaaggcctcacaagtgctgggggaaaaaaaacagcaatgaggatgatcctgagttaatgtgtatgctccgcaagagagcttgcctataccttgattatttcataaaatcacatgttaatacattgctttcagaatgaaatactgacttgatctgataggagaaaatggtaatatttcatagttgttttccaaagacaaatttaaatgttgtctgttatctccttacttagtttaagaatttagttttgaaccccattgactttgtcatttgcaattttaaaaatatttgggactgggcatggtcgctcacgcctgtaatcccagcactttgggaggctgaggcgggtggatcatgaggtcaggagatcaagaccatcctggctaacatcgtgaaactccgtctctactaaaaatgcaaaaaattagccaggcgtggtggcgggcgcctgtagtcccagctactcatgaggctgaggccggacaatcgcttgaacccaggaggtggaggttgcagtgagccaaaatcatgccactgcactccaccctgggcgacagagcaagactccatctcaaaaaaaaaaaattggaaggtatctgtaaaatgtcaaagttaagatgaagttatatctgtttggaatagcactttgccctaaatatcatttcttgaattttcaagcctaaagatgtttaaaaatatgaatagttacaaatattcttatacatattttttatcatgatcacaacaaaattttgtttatgtggttctgcaatataatttctgtgaagtattacaagtatttatgaaaaataagcatagtgatcagaaattttaaagattttgtataaaaacatttgggagatttgactttatacatgcatagatttgcattttactttcccttttgaggcagcatttttagaaaatcagtaagaaaaatgtacatcttaaggtctactattttacatttctacacagaattttagtgttaatgttccatgtgtctatactgtttatttcaaaactgagaaattcatgggaatgatgtattttgtggaatcaagaacaaaattatagtgggataattttacatcttaaatatttctttctactactgtaagctctactttggaattatctgagtagaaaatcagaagacattatctaactttgtagatacactgtatgattgggctttttgttcagattgtaatttcattaatagatgaaatatttatgctaatattttcttatttcaaaagcaaaataaaatgaatttattgtcctgtg

SEQ ID NO: 28601 - DNA, 340 bp, Homo sapiens
gaaatggaggtgttctgacctatgatcagacaaggtaggtcagaaaccagctccagaaaccaggaaaaagttcctgccttggggagagaaagaaataggtgaaaggagggcagaaaaggagccctgcctgttttgctcgttgttgcctcactagcccataccagagtgcagggtgcgctgtaagccgtgaccgcatcacagatcatcagcatgcagagatggcgagtaacccatgggccaggtagcgttctatgccaaccttgaatgccatcaggaagtcactggacagcaaactcttccaagatcataacttggctgttggagcaacctggaaaagaag

SEQ ID NO: 28602 - DNA, 1423 bp, Homo sapiens
tcagtctcgccggcggcccccgctcccggatccccagcgccctggccaagaagcttcctcggctccccctcttccctctccctgacacggttgtgcagagggcgcggtggctcagatacaggatttcgacatattggccggtttgctctcgagctcctgggctcaagcgatctgcccgctttagcctcccaaagtgatgggattacaggcgtgagccaccgtgcctggccataatttttaaaaatgtctagtcagatggcgagtaacccatgggccaggtagcgttctatgccaaccttgaatgccatcaggaagtcactggacagcaaactcttccaagatcataacttggctgttggagcaacctggaaaagaagaaaaaagaaaaaccatggcaaaagtaaatagagctcggtctacctcccctccagatggaggctggggctggatgattgtggctggctgtttccttgttaccatctgcacacgggcagtcacaagatgtatctcaattttttttgtggagttccagacatacttcactcaggattacgcacaaacggcatggatccattccattgtagattgtgtgaccatgctctgtgctccacttgggagtgttgtcagtaaccatttatcctgtcaagtgggaatcatgctgggtggcttgcttgcatctactggactcatcctgagctcatttgccacgagtctgaagcatctctacctcactctgggagttcttacaggtcttggatttgcactttgttactctccagctattgccatggttggcaagtacttcagcagacggaaagcccttgcttatggtatcgccatgtcaggaagtggcattggcaccttcatcctggctcctgtggttcagctccttattgaacagttttcctggcggggagccttactcattcttgggggctttgtcttgaatctctgtgtatgtggtgccttgatgaggccaattactcttaaagaggaccacacaactccagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaagattttgtataaaaacatttggcatttttagaaaatcagtaagaaaaatgtacatcttaaggtctactattttacatttctacacagaattttag

SEQ ID NO: 28603 - DNA, 4819 bp, Homo sapiens
gctgcatggccgcctcctcccctcccaggccgccagggatttgccgggaagagcgggggcagggggagactcccgggggtgcgcaggaccgcggggggccgagtcctcgggctcgagaagattgtgtccacccgctgtccgaggcccaggctgtcccctcaggtcgtcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaatttg

SEQ ID NO: 28604 - DNA, 4536 bp, Homo sapiens
gtatgttcaggattctaaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaatgataatttatttttaaggtaaaaataatccatgaagataaaagaaacatatgtctgcgtgctactttacaatgttggttttaaagataagcacatgggtaaaaatgagggtgatccttattcaaaaataacatctgactactataaaaatatttgcatatataagtttgacaaagaaaagaaaatcaatgttaaaccattaaatctgagcactgttagacttgattaatccatgcacatgattttttttgagtagggagcattagtacctggtgctagagaatagaaccctcaaataatttttagaattcttacctaatatgtaaaagtctgcatgactcttaacaatgagtcacatccattgattttacagggattttagttcgtaatccagaaagtaataatcagggattttattttaatcaggcatcaatccagattcactgttatactgaaatatcaaagtaaaatcctagttggcaggattgtaagtagaccgaattctaatttttcccaacacatagtggtaattggaggttactgttatgaatactccatctgactacgactaagagagtgaggggtggttttaatgaaccctctaagctctctcagttccttcccttccacaaaatgcaagagcaaaagcaaactacaaacaggccttgtgctcaaccactggaaatgcctcctgggataagaatggcagcacttgaaaattctgccctctactgatgagacttcctgctgcctttggacataactaagccaggaaactttaaaagccttctagaaatagaggcactgtatgacttgcaatcgtaggtatagtttataacctgatagcaaaaaacttgaaatattgcagcccagtttaattcagcactttcccattttcataactatgtgaaaacatctgggaatttgaatcactcctgaatacagaggcatattctttttaaactataaataccattttgagtgagaaagtacttttaaacaagaaagaaattgtacattatgactaaagttataaatacaatatttatatctataaatctgaagtttaacatgattaatttaaaaagtatttagtgcttgacaaagtagtgtcactcttaagatgtcaaagggaattagccattttttttattgtaataaaggcaggtgctatttttttctggtgagattgcacctggataccaggcttttgtaatagttaacattaaacatttgattcataaagttaattcactgcttaagcatgtggctcatatttaggaagctatataaaattcagtttttcatttaacatttgctcttttgcatatgaagagatatttgtatttttcaaatgttaagtaaaacaagatgtgccaatatcataggtaaataaattagggaaaatgtgggactttatggctgtttttaatttagtttcacccgatcttgattcttgaattagctatgtttatatttttagttcttttttattcaactcagatttgtcaagaaatgtaacctctaaattgtgtagtacctctccaatcataaattttcaaaaaaaaattctactttccaaaaagtgtcttgaattctctgaaaaggcacattaaactaatatgaacatcagataccagggggaaataaatggcaaagtaataatcatgaggttttaggtcaaagactacattatatatattttttattaccttctagtagagacatcctcctgggtgcatttcagtggccttctccagggaggaggtttatttacttactgatgagtttctcgtcacgtcaaaaccagttcacatttgtctggctgctctttggttgtcttcattcgttatttatttctaacactgtattaaattgttagaaaagaaagtaaaacttgcacattcaaagcacatgatttgtacagtcacacctggcagtagcactgcacagttacaaatatgcacacacgttaactgctatgcataaatattgacagttaaaccagaacacaattgaaacagtgacataaatacctacaggattcagaattgttccagggtaatataaattattctacttgttcactctccccaccctcttgaacttgttagaagatttgctgctttagcagaatctttccaagattgagaaaagtgtatcaacctaggattttcattactatatagtcacataaatggaggaggagatatatttggcttctgcctctgcaacaattagtatgaacatatttctttctctagggaataataggttttaaacatttgagatatcatgaagcaaagtcagggtataccactacaatccccactaatctctattcccacattatgaaattgtacagaagaaagggtgtcattaaatcaaggtatccagataa

SEQ ID NO: 28605 - DNA, 1878 bp, Homo sapiens
aaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtagaatatttgaaagctttttgatcttcacatccttgaggattcagtgcagctttactcaatcaggatcatgcctagctgccgtacataatgactcctctgatgaatctgggaaaaggagatggaaaatcttctggaaaggatttgctattctagataacatcacgatcattcactgttatgggaggaggtcaaaataccaacattaacagaagtttggaagaagtttatttcaatcctcatgggtgactttaagaggctcaggacttcagtgaagtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctg

SEQ ID NO: 28606 - DNA, 1969 bp, Homo sapiens
attccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatgga

SEQ ID NO: 28607 - DNA, 1815 bp, Homo sapiens
agcggatgctgcatcgcggcgcccttctccacccccttttctcctctacttccgcgaaaaggattgcagactgccttggaaagggcggtcgtgcccagtgccactttcccggagtcaatcttaagatgtgatactttcctgtgaaacctgaaacaaggtgatctggggaaccaaagactctgggactcttggtgccaacagagttactctataatccaaaatctactctacatcttttcctttgtattgccttcaaatatcactcttcaaagtttagtgactaggcttaaagattccacatataatccaaagaaatctgttcaagtggacatctatcaacacgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaa

SEQ ID NO: 28608 - DNA, 2250 bp, Homo sapiens
tccccttcccgccaccgcctccttctccgctggctgtggcgggcgaggacacgtcaggggccataaataaataaataattccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaa

SEQ ID NO: 28609 - DNA, 3646 bp, Homo sapiens
agtttgaggccaacactaggaagtgtctggaaccggatccggaggcttcacaatctatatgttgcctccaaaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgc

SEQ ID NO: 28610 - DNA, 4174 bp, Homo sapiens
gtgcgcaccgagagggcgcctggccgacggcgcccacctctctcgtggctttggtggctccaggcctggtagggccggggccgcggctcgggcagtgccctccctactcctggccgggccgggagcagcgggagcaggcgcagcgcccctaccgcccgcttttccgcctccatctcctccgcctcctcctcctccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgc

SEQ ID NO: 28611 - DNA, 452 bp, Homo sapiens
gccgggtgctgagcaccggaggccccgccgaggccgggactcaggtaacctgctctggcttcagcagcgcccagaggctttccagagagctgataaccacgaacaaacttggctgtcaaaagcaaatcaatgctttaccttgttttctgggtgcctagtctatccaacacaaactatccccgaagtttagtcaggatttacgctaaatatattacttatatagacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgc

SEQ ID NO: 28612 - DNA, 3455 bp, Homo sapiens
ggctcactttgcgccaatcctacgagaactcccagaactccgcttccctagtccaacccaagccagagttgcccacacctaagatggcggcgggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagagggtgttacatttccagccatgcatgccatgtggtcttcttgggctccccctcttgaaagaagcaaacttcttagcatttcatatgcaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagagaatgggtttttatcttcattgccttatttaggctcttggttatgtatgatcctgtctggtcaagctgctgacaatttaagggcaaaatggaatttttcaactttatgtgttcgcagaatttttagccttataggaatgattggacctgcagtattcctggtagctgctggcttcattggctgtgattattctttggccgttgctttcctaactatatcaacaacactgggaggcttttgctcttctggatttagcatcaaccatctggatattgctccttcgtatgctggtatcctcctgggcatcacaaatacatttgccactattccaggaatggttgggcccgtcattgctaaaagtctgacccctgataacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 28613 - DNA, 1129 bp, Homo sapiens
cagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagagaatgggtttttatcttcattgccttatttaggctcttggttatgtatgatcctgtctggtcaagctgctgacaatttaagggcaaaatggaatttttcaactttatgtgttcgcagaatttttagccttataggtatgctggtatcctcctg

SEQ ID NO: 28614 - DNA, 1844 bp, Homo sapiens
attgtgtaaagttgagagaaaagtcttcacagcggaagaagaaatcacttttttgtcccgaatcagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccactggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcaccagcaccaggaagaaggtggtaggaggagtcctaggggccagttttaccctcccacatatcctgtgtgcatcgttttttaacatgtgttgtttgtaacatgtaatatatctgaattttaaatgggggtggtgatttatctcagtcttcctctctgcatcagttgctttataaatgattgtcaaaccaataaatacacacaagataaaattttattctaaggcttcatgaaa

SEQ ID NO: 28615 - DNA, 1433 bp, Homo sapiens
cagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtcagttcaagtagacaatctctgcctatcaaggctatacttaagtcgcttccagtctgggctatttccactggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcacca

SEQ ID NO: 28616 - DNA, 1679 bp, Homo sapiens
attgtgtaaagttgagagaaaagtcttcacagcggaagaagaaatcacttttttgtcccgaatcagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcaccagcaccaggaagaaggtggtaggaggagtcctaggggccagttttaccctcccacatatcctgtgtgcatcgttttttaacatgtgttgtttgtaacatgtaatatatctgaattttaaatgggggtggtgatttatctcagtcttcctctctgcatcagttgctttataaatgattgtcaaaccaataaatacacacaagataaaattttattctaaggcttcatg

SEQ ID NO: 28617 - DNA, 1242 bp, Homo sapiens
atgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctga

SEQ ID NO: 28618 - DNA, 1704 bp, Homo sapiens
aaaagtcttcacagcggaagaagaaatcacttttttgtcccgaatcagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccactggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaaggtgagaagtgatcagattaaggacaatttttgaaactgggaatgcaggagacagaggagataaggatgactcctcagacgagaaggaataacgggtgcaggtttggagaagaggagaccatgttaagcctgagaatattagacatcctgaaatggctgtgggactctgtggggatgctaaggctggagatataaatttgg

SEQ ID NO: 28619 - DNA, 1493 bp, Homo sapiens
accatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgggctcctccttccatcaatatgtgctgtggccctgccctttgtggcctccagttacgtgataaccattattttgctgatacttattcctgggaccagtaacctatgtgactcagggtttatcatcaacaccttagatatcgcccccagatatgcaagtttcctcatgggaatctcaaggggatttgggctcatcgcaggaatcatctcttccactgccactggattcctcatcagtcaggttgggccagtttattgaacatcttcaagtggcaggattttgagtctggttggaggaatgtctttttcctgtctgctgcagtcaacatgtttggcctggtcttttacctcacgtttggacaagcagaacttcaagactgggccaaagagaggacccttacccgcctctga

SEQ ID NO: 28620 - DNA, 2270 bp, Homo sapiens
ggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcggaactgtaaagctataatccccagaattaaagtttttattattttttatacattgtaaaacatagacgtttatttatgtgattaaattctattaaaatttacatgctaaaataaaa

SEQ ID NO: 28621 - DNA, 2525 bp, Homo sapiens
gccgaggctttctgagaaagtggggccaaacctgttgccgtctgactgccacgtggctcactatttatccctgtaaaaatctgcaaaagtatttgaaagggaagaagggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgggctcctccttccatcaatatgtgctgtggccctgccctttgtggcctccagttacgtgataaccattattttgctgatacttattcctgggaccagtaacctatgtgactcagggtttatcatcaacaccttagatatcgcccccagatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcggaactgtaaagctataatccccagaattaaagtttttattattttttatacattgtaaaacatagacgtttatttatgtgattaaattctattaaaatttacatgctaaaataaaa

SEQ ID NO: 28622 - DNA, 1750 bp, Homo sapiens
gtcggggccagagcgcaggtgtacctggcggccgtgctggagcacctgaccgccgagatcctggagctggctggcaacccggcccgcgacaagaagacccgcatcatcctgcgccacctgtagctggccattcgcaacggcgaggagcttaacaagctgctgggcgaagtcaccatcgcgcagggcggtgtcctgcccaacattcagggcgtgcttctgccccagaagaccaagagccaccacaaggccaagggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaa

SEQ ID NO: 28623 - DNA, 1543 bp, Homo sapiens
ggaaacgctgggttcaacttgaagcccttccacagacattaagtcggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaa

SEQ ID NO: 28624 - DNA, 2052 bp, Homo sapiens
gctccaaaaagtccaagggagtaagcttggaggaaacgctgggttcaacttgaagcccttccacagacattaagtcggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaatgcagttgtcatcttcatagaattaacaatggattaagagggcttgctgtgtgggacccagtatgttagattccattactggatacaagaaacaatgttttaaaacctttaatccggggtgacaaactcactagggcaatgatttttcctgtttgtgaaaattaatattactttctatttattgggttgagtattgtccatgtgttcttccctatatgtcctccatttatctccatcctgctca

SEQ ID NO: 28625 - DNA, 599 bp, Homo sapiens
tgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagaaaatgccagaaattgcccagcatgaaacaggacagtacaaacattctgcaacacacagaagaggaccagcagaatctggacttttgaaaaagaaaaaatctaactgaataacaacatcaaagtctcctgggcaaaggggttaaagatttacaacatttctttagaggaaaaaaataactggttgaatttacagagcatctgctatgtgccaaacatttaatgagcactttaaaagcatgataaaaattaaaaaaaaacttgttaagcatgaaataaattacctataatgcaaaatca

SEQ ID NO: 28626 - DNA, 661 bp, Homo sapiens
agtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaaggcagtaccaaccttggacagggatggggtaatgattcacatttatggggggaaaaattatctttgtgtgactccagtcacagtttgcttctatcaaatcttcagtctccaatgaagtttaaatattcctgggaatcctaatgaaggactgtttttatgagttttgtgttatcattgtaatgtcaagattgtgtgtcaagtcaatatgaagtttaaaaccatttccaatatgttcacttgatttactcttttccattatttggatatcccattacacaggcacagtggatgatttaagtattccaggaagctgtttctataccaaagtacctagcaataatgtaacaattccccttatcaacccaaaccacataaatgtatcccaaattttggtccaatgaaatgcattcccactgcagccttcccttcaccatatcaaaaaatgccaagagcaactccatagtactatggtacccaataggatggagatagtaactttaaaca

SEQ ID NO: 28627 - DNA, 3616 bp, Homo sapiens
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagactgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaa

SEQ ID NO: 28628 - DNA, 2331 bp, Homo sapiens
tcagtaagtaaatgccagtccctaggaagagagaaccaaaatgtctaccggaccagatgtcaaggctacagtgggggacatttccagtgatggcaatttaaacgtggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggtaagggagagactggacacaggggtgaacgtgggaagctcagagcagccttcagtttactctgtgtttgtcctcctaccccaggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtagggacctcttttgcctcatcctttcagacactcaattcaagtctagcagccctaaatctactctgatgtgaaagtaaaatgtggcaggtacaacaggttgcaggaaatgtcagcaccagctctacatcctacatctaaataattcctggaagagactcaaagctggtggaccattgtgaacttagtttttctgggcgtgaacaagaggagtcagtggccatgctcagagtcaactgagggagactcacacaaacctctctctgttgaggaatgcagcacttgcctaaggcggaatcactgaaagaaatcttgagattctatagggtatgctcatgaaaatctttaatgaaggcaaaggacacaggactgcaggagaaatatctgtctctgatacagtaaaaacagttgactgagacttccaaacatagctcccagggtgctgtcccagtcaacaggacatccttcatcttcagataatgaaccaccaagaaatgtgagagatgcccttgtcacaggggagccgacgtctcatctggtgaggggtcttttatacccacggagggtataaaagttacaagatcagactcaacagcagaagccaaaacaacaacaacaacaacaacaacaacaacaacaacaacaacaaaaaccttacaaaccaggtgcagaccatcaatctgaccatcttgcataaacaatgttgacaagttaatagaggttacccccttgggagtaccagtccctagcacaggattatactaatcattggtcagtacatttcattcaggtttcaccaaggcttacacaattccagtcatctccagaggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccg

SEQ ID NO: 28629 - DNA, 1664 bp, Homo sapiens
ttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatgagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttg

SEQ ID NO: 28630 - DNA, 3949 bp, Homo sapiens
gcttctgtgatattccggcccctccgtttaaaagccatcagatttgagagcaataagtcttcaaaaccgggaatttacattgtttttcagctgaccgacttccaggaaaaggactcaaccgcatctacccaaataccgtggcactgcttgcgctctttgccaccggatcctccccttccaatgagactttctgattgtgtctaccaactctcctattaggaaacccgtgggttgcatgcagctattctgttgtattctcattctcactctccctcccttctctcactctcactcttgctggaggcgagccactaccattctgctgagaaggaaaagcccgcaactactttaagagattaagacaatatgcgcaatcctcgcctttcctagcaatcactatttaaatctggcaagaactgacaacagtctttgcaagaatggaatccgtaaaacaaaggattttggccccaggaaaagaggggctaaagaattttgctggaaaatcactcggccagatctacagggtgctggagaagaagcaagacaccggggagacaatcgagctgacggaggatgggaagcccctagaggtgcccgagaggaaggcgccgctgtgcgactgcacgtgcttcggcctgccccgccgctacattatcgccatcatgagcggcctgggcttctgcatctccttcggtatccgctgcaacctgggcgtggccattgtggacatggtcaacaacagcaccatccaccgcgggggcaaggtcatcaaggagaaagccaaattcaactgggacccggaaaccgtggggatgatccacggttccttcttttggggctacatcatcactcagattccgggaggctacatcgcgtctcggctggcagccaacagggttttcggagctgccatacttcttacctctaccctaaatatgctaattccatcagcagccagagtgcattatggatgtgtcatctttgtcagaatactgcagggacttgttgagggtgtgacctacccagcatgtcatgggatatggagcaaatgggccccacctctagagaggagtagactggcaaccacctccttttgtggttcctatgccggagctgtgattgcaatgcctttagctggcattcttgtgcagtacactggctggtcttcagtgttttatgtctacggaagctttggaatggtctggtacatgttttggcttttggtgtcttatgaaagtcctgcaaagcatcctactattacagatgaagaacgtaggtacatagaagaaagcattggagagagtgcaaatcttttaggtgcaatggaaaaattcaagactccatggaggaagttttttacatccatgccagtctatgcaataattgttgcaaacttctgcagaagctggactttttatttattgcttattagtcagccagcatattttgaggaagtctttggatttgaaattagcaaggttggtatgctatctgctgtgccacacttagtaatgacaattattgtgcctattgggggacaaattgcagattttctaagaagcaagcagattctttcaactacgacagtgagaaagatcatgaattgtggtggttttggcatggaagccacactgctcctggtcgttggctattctcatactagaggggtagcaatctcattcttggtacttgcagtgggattcagtggatttgctatatctggtttcaatgttaaccacttggatatcgctccaagatatgccagtatcttaatgggcatttcgaatggtgttggcacattgtcaggaatggtttgtcctatcattgttggtgcaatgacaaagaataagtcacgtgaagagtggcagtatgtcttcctgatcgctgccctagtccactatggtggagttatattttatgcaatatttgcctcaggagagaaacaaccctgggcagacccggaggaaacaagtgaagaaaaatgtggatttattcatgaagatgaactcgatgaagaaacaggggacattactcaaaattatataaattatggtaccaccaagtcttatggtgccacaacacaggccaatggaggttggcctagtggttgggaaaagaaagaggaatttgtacaaggagaagtacaagactcacatagctataaggaccgagttgattattcataacaaaactaattactggatttatttttagtgtttgtgattaaattcattgtgattgcacaaaaattttaaaaacacgtgatgtaaacttgcaagcatatcaaccaggcaagtcttgctgtaaaaatgaaaacaaaacaaacccatgaggttaccatcaagtgcaatctgtaaaattgtgaagttccatcatttccattcaagtcatccattcttgcatttgtgacttaaaggttgactggtcaaaattgtagaaacaagtagttacccattggattcatatgagctaaaactcatcactatttactaaagcacaacatctcatcctacaaaagttaagaagccaaagctacttgatcatgcaaaatgcacttatatatttgttacactgtattgcaagatagcacacagaagttggctgcgtcaagtagaggcgacatttattaagtgaaaatcatggagttgggatatctctcaattaaagaaatacattgtgaactatcagctacaaagttgtactgaataactattagaattgcataatgtgagatattttgttagtcctcaaaaggaatatcttgcagtgttttctatgaaatgcttgggcacaaacacttatttctgtgaaagagaacatgtaagttgaggggtatgcttcatgttcttccatccatttacctaatagtatgaaacagttcacatttcaataaaatcaaacttttcatgtagcgtatcacataacttttttgcaaaaaatataaaaagaaataaacttcaatgtattttttattacaactttgtactggttgtaacttgcattagaaaaaaaagagatatatacaccacaaagaatctaataagaaatttattatggagatatagcccttaaaatgcaatattaagaacaaagaaatagaaaatggtttagatatctttcttccttcataattaaatactatatgaaacttgtgccacagagctatatataatatgaaaagattaacttcatagagatattgtaagtaggtaattttattatttaaagtcctattaagaaatatttgtcttaaatatataggacaatacattatattaaaatggtctctctctatatatatctgtatatcttatacatgtccatacacagaaacataataaacaatcttcacacgaaaccaaaaatagcatacacctaatgttgggttagggaattgcaatttctactttcatagagtcatagaattttaggtggggaagaggcattttgcttgtcatttcttaatataactcaacaagaattgcaacatttgtgtaccaagcaataagtgcaatgcataaaatttcctgtctgtatattaccttcattttgcttgtagtagctgtttgggtggttggaataattttatttttcttttaaaaaagctaacatcagacccctttataatgtcctaaaattatgataatacatttcccaattcaactcaaaatattattggtgtattttgtctattctggatatttgatctgttcaatgtactgtgctagtgactggaggccctgctactgcaaatataaaacataaagtttgtttaaaaaaatgcaaatcattctttaccttaagaaaaaaaaaataccctttgctttgtgcctcaaagtgatgtaatgtgatcacagcttttgttgtgttgaatgaaaatatgtggactgtcattttgttgcagcaaaaaagtgttaataaaatgctctatttatcctttttttaaaaa

SEQ ID NO: 28631 - DNA, 1870 bp, Homo sapiens
agaatttcccgatttaagtctccagggttggaagtcactacactactgtgtctgcattggccggattcgttaagtggacccctgacaggcgtctccacatctggctaacaaatctcttcatgaaagccaaattcaactgggacccggaaaccgtggggatgatccacggttccttcttttggggctacatcatcactcagattccgggaggctacatcgcgtctcggctggcagccaacagggttttcggagctgccatacttcttacctctaccctaaatatgctaattccatcagcagccagagtgcattatggatgtgtcatctttgtcagaatactgcagggacttgttgagggtgtgacctacccagcatgtcatgggatatggagcaaatgggccccacctctagagaggagtagactggcaaccacctccttttgtggttcctatgccggagctgtgattgcaatgcctttagctggcattcttgtgcagtacactggctggtcttcagtgttttatgtctacggaagctttggaatggtctggtacatgttttggcttttggtgtcttatgaaagtcctgcaaagcatcctactattacagatgaagaacgtaggtacatagaagaaagcattggagagagtgcaaatcttttaggtgcaatggaaaaattcaagactccatggaggaagttttttacatccatgccagtctatgcaataattgttgcaaacttctgcagaagctggactttttatttattgcttattagtcagccagcatattttgaggaagtctttggatttgaaattagcaaggttggtatgctatctgctgtgccacacttagtaatgacaattattgtgcctattgggggacaaattgcagattttctaagaagcaagcagattctttcaactacgacagtgagaaagatcatgaattgtggtggttttggcatggaagccacactgctcctggtcgttggctattctcatactagaggggtagcaatctcattcttggtacttgcagtgggattcagtggatttgctatatctggtttcaatgttaaccacttggatatcgctccaagatatgccagtatcttaatgggcatttcgaatggtgttggcacattgtcaggaatggtttgtcctatcattgttggtgcaatgacaaagaataagtcacgtgaagagtggcagtatgtcttcctgatcgctgccctagtccactatggtggagttatattttatgcaatatttgcctcaggagagaaacaaccctgggcagacccggaggaaacaagtgaagaaaaatgtggatttattcatgaagatgaactcgatgaagaaacaggggacattactcaaaattatataaattatggtaccaccaagtcttatggtgccacaacacaggccaatggaggttggcctagtggttgggaaaagaaagaggaatttgtacaaggagaagtacaagactcacatagctataaggaccgagttgattattcataacaaaactaattactggatttatttttagtgtttgtgattaaattcattgtgattgcacaaaaattttaaaaacacgtgatgtaaacttgcaagcatatcaaccaggcaagtcttgctgtaaaaatgaaaacaaaacaaacccatgaggttaccatcaagtgcaatctgtaaaattgtgaagttccatcatttccattcaagtcatccattcttgcatttgtgacttaaaggttgactggtcaaaattgtagaaacaagtagttacccattggattcatatgagctaaaactcatcactatttactaaagcacaacatctcatcctacaaaagttaaga

SEQ ID NO: 28632 - DNA, 2975 bp, Homo sapiens
tgtgacagcccccgggccgcctgcacttgcagcctccttccccccgagcggagctgcggggccggccgggccggggctggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagccaggggtgttttttcccagtgcagggttgtgtctttgtgtctctgtctctgtgactgtaaatcctgccctgccccactcccaataaaagctttggtgtataggctc

SEQ ID NO: 28633 - DNA, 2237 bp, Homo sapiens
gaactcagagcgcggacagatcccagaggagcagagaaataacacaatggggagactatggggtcgcagctggcactggcgggccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctga

SEQ ID NO: 28634 - DNA, 3954 bp, Homo sapiens
gagagtggctgcctgagacagctgccacaggctgctgcagagcgtgcagcttttgcaagggactgaattcccagccagacaccccttggactcttttttggaggggtggggagcagagagaggagggagttgtcttatcttggaagatccgagctgggtttcatctcctttttgattttgagtagttccctccacgagaactgacttccaggtgttcaccaagggaaacaaggtggttctcacactggaaatgaggaaggatgacagtttttgagactgactgttaacggctcagaggtgcccctcattcaaaatgccttttaaagcatttgataccttcaaagaaaaaattctgaaacctgggaaggaaggagtgaagaacgccgtgggagattctttgggaattttacaaagaaaaatcgatgggacaactgaggaagaagataacattgagctgaatgaagaaggaaggccggtgcagacgtccaggccaagccccccactctgcgactgccactgctgcggcctccccaagcgttacatcattgctatcatgagtgggctgggattctgcatttcctttgggatccggtgcaatcttggagttgccattgtggaaatggtcaacaatagcaccgtatatgttgatggaaaaccggaaattcagacagcacagtttaactgggatccagaaacagtgggccttatccatggatcttttttctggggctatattatgacacaaattccaggtggtttcatttcaaacaagtttgctgctaacagggtctttggagctgccatcttcttaacatcgactctgaacatgtttattccctctgcagccagagtgcattacggatgcgtcatgtgtgtcagaattctgcaaggtttagtggagggtgtgacctacccagcctgccatgggatgtggagtaagtgggcaccacctttggagagaagccgactggccacaacctctttttgtggttcctatgcaggggcagtggttgccatgcccctggctggggtgttggtgcagtacattggatggtcctctgtcttttatatttatggcatgtttgggattatttggtacatgttttggctgttgcaggcctatgagtgcccagcagctcatccaacaatatccaatgaggagaagacctatatagagacaagcataggagagggggccaacgtggttagtctaagtaaatttagtaccccatggaaaagatttttcacatctttgccggtttatgcaatcattgtggcaaatttttgcagaagctggaccttttatttgctcctcataagtcagcctgcttattttgaagaggtctttggatttgcaataagtaaggtgggtctcttgtcagcagtcccacacatggttatgacaatcgttgtacctattggaggacaattggctgattatttaagaagcagacaaattttaaccacaactgctgtcagaaaaatcatgaactgtggaggttttggcatggaggcaaccttactcctggtggttggcttttcgcataccaaaggggtggctatctcctttctggtacttgctgtaggatttagtggcttcgctatttcaggttttaatgtcaaccacctggacattgccccacgctatgccagcattctcatggggatctcaaacggagtgggaaccctctctggaatggtctgtcccctcattgtcggtgcaatgaccaggcacaagacccgtgaagaatggcagaatgtgttcctcatagctgccctggtgcattacagtggtgtgatcttctatggggtctttgcttctggggagaaacaggagtgggctgacccagagaatctctctgaggagaaatgtggaatcattgaccaggacgaattagctgaggagatagaactcaaccatgagagttttgcgagtcccaaaaagaagatgtcttatggagccacctcccagaattgtgaagtccagaagaaggaatggaaaggacagagaggagcgacccttgatgaggaagagctgacatcctaccagaatgaagagagaaacttctcaactatatcctaatgtctgagaggcacttctgtcttctccttactttagaaacagaaagtatccatacctattgcctttcttgtagcccagcttgccagaggtccaaatattgggaggggagaagatctaaccagcaacagggaaaagagaaatattatctttcaatgacatgtataggtaaggagctgcgctcagttgataacatagttgataatacatattttttgaattgacagttgacccttctctcaaagagctaaacttattcagaaaggaatgactagaagaaaaaggagacaataccatgttgttcaaagaaacattgaaggaaattgggatgtttggccagaaggaatgtaaacagtagtagtagctgccaccacatctctagggtagccatgcagaggagggcttcatattcccaataaaccccacgttgtggcaggtgctttataaacactcttatttaatctccacacctttatgacacacatttcttatccccattttacaaccaaggcatctaaagcaacaagaaatgaacttgcccaaggtcatctgccagggtcagtgctgagactgttgaagctctcaataggtggcagttttagggaagatttccattcagtgtagggaagacatttgtaataatgaaaactgaaaatggagtaattgtgagtaactcaccactttagcaggtgttggggaagggaaacatttgggttgatgaggcagaggggattcaaatgtgtgagaggctagattcaaagaccctcagtgttctatgttatctgaagagtcaaatggttttgtgactccatagtttttaaagtaataagggtcaaagactacatcagagattcaaataggtttttaaagaaaagctaagcaagagagccaaatttttagaaatctgatggtcaaaatagctgaaagcagtaaacaagagattggctattaaatttcaactttccataatattaagaatgtagctaaatgatgtcccaaactacttacaaacttttaagacatttaataatttaagaagtaggttcatgtgttttcttaggtaaagttcttctgaaagaattttctatttttaaaaaatgtatctctttagccttttctgctggagattatattaggaagtttcatcagattgtataaaattatgattttgtatcaaaagtattcatgatgactctatttggaatgatattcagggaaatcacaataatatagcagtagttatacagagaaatactacaatgaaaacatttggggcaattagacctacagttactgttgaaaaattcacctttgattgcataaggcaattacatggatacttttagatatatttaaaattttaacattggcatctaaagtgttatttgaaaataaaattattttcctgttcattgattttaaacattttattcctactttcagaagaaaaatataatacggaaaaaattatagatttacttgtagcttattattgtaaagtgttttttttttttttttttttttctaatttctcccacatgtatttctggtccccagtgatactagctgagttgtagtgtattttataaatggaataatcttggggaaaaattgcgattcttcattaaataatattctttatgtcactagcatacaatttatgttagtagacatctttaaatctctttaatgagtgaatccatgcaagccccataaaacagttcctagcatgcagaaaatgcccacgtaaatagctgtcatcatcattatcttttaacattttgggggactttccagttgaaaagaaaacatgctatgtcatttttatccattatccctggaacttattgtgaaagttgtgctgttttctaagt

SEQ ID NO: 28635 - DNA, 1737 bp, Homo sapiens
gctcagaggtgcccctcattcaaaatgccttttaaagcatttgataccttcaaagaaaaaattctgaaacctgggaaggaaggagtgaagaacgccgtgggagattctttgggaattttacaaagaaaaatcgatgggacaactgaggaagaagataacattgagctgaatgaagaaggaaggccggtgcagacgtccaggccaagccccccactctgcgactgccactgctgcggcctccccaagcgttacatcattgctatcatgagtgggctgggattctgcatttcctttgggatccggtgcaatcttggagttgccattgtggaaatggtcaacaatagcaccgtatatgttgatggaaaaccggaaattcagacagcacagtttaactgggatccagaaacagtgggccttatccatggatcttttttctggggctatattatgacacaaattccaggtggtttcatttcaaacaagtttgctgctaacagggtctttggagctgccatcttcttaacatcgactctgaacatgtttattccctctgcagccagagtgcattacggatgcgtcatgtgtgtcagaattctgcaaggtttagtggagggtgtgacctacccagcctgccatgggatgtggagtaagtgggcaccacctttggagagaagccgactggccacaacctctttttgtggttcctatgcaggggcagtggttgccatgcccctggctggggtgttggtgcagtacattggatggtcctctgtcttttatatttatggcatgtttgggattatttggtacatgttttggctgttgcaggcctatgagtgcccagcagctcatccaacaatatccaatgaggagaagacctatatagagacaagcataggagagggggccaacgtggttagtctaagtgtgggtctcttgtcagcagtcccacacatggttatgacaatcgttgtacctattggaggacaattggctgattatttaagaagcagacaaattttaaccacaactgctgtcagaaaaatcatgaactgtggaggttttggcatggaggcaaccttactcctggtggttggcttttcgcataccaaaggggtggctatctcctttctggtacttgctgtaggatttagtggcttcgctatttcaggttttaatgtcaaccacctggacattgccccacgctatgccagcattctcatggggatctcaaacggagtgggaaccctctctggaatggtctgtcccctcattgtcggtgcaatgaccaggcacaagacccgtgaagaatggcagaatgtgttcctcatagctgccctggtgcattacagtggtgtgatcttctatggggtctttgcttctggggagaaacaggagtgggctgacccagagaatctctctgaggagaaatgtggaatcattgaccaggacgaattagctgaggagatagaactcaaccatgagagttttgcgagtcccaaaaagaagatgtcttatggagccacctcccagaattgtgaagtccagaagaaggaatggaaaggacagagaggagcgacccttgatgaggaagagctgacatcctaccagaatgaagagagaaacttctcaactatatcctaatgtctgagaggcacttctgtcttctccttactttagaaacagaaagtatccatacctattgcctttcttgtagcccagcttgccagaggtcca

SEQ ID NO: 28636 - DNA, 2594 bp, Homo sapiens
ccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggtggaaccaccctgtgtatgcatgaccctgacaagcaggcgccaggacagtcaggaggccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacaacagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaa

SEQ ID NO: 28637 - DNA, 2539 bp, Homo sapiens
gagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacaacagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaa

SEQ ID NO: 28638 - DNA, 565 bp, Homo sapiens
ggaaggaagtgagtgccctgtccttcctccctgccatgagattccaggaccggacctggcaagtgccctatcccagccagtgttcctggggctcttccaggcagggctatgttccccaggccaggggcattgtcctggacagtcaggaggcatacccctcgccaggtggaaccaccctgtgtatgcatgaccctgacaagcaggcgccaggacagtcaggaggccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaag

SEQ ID NO: 28639 - DNA, 2419 bp, Homo sapiens
ggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgcgtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgtagagcctgcatctgtctgtccttccttccattgctcccagtgccaaacttgggccgctgcaccgcggcgcctccgcccaaatcaataaactgtgtctgtcccagg

SEQ ID NO: 28640 - DNA, 2770 bp, Homo sapiens
gctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatcccagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcaggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattca

SEQ ID NO: 28641 - DNA, 2753 bp, Homo sapiens
cacacacacacatacacagaatcctcagataacaggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattca

SEQ ID NO: 28642 - DNA, 2822 bp, Homo sapiens
cacacacacacatacacagaatcctcagataacaggaggcaataaatccaacagcacatccacgttcagagaacagtgtccctgctgtcttgctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatcccagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattc

SEQ ID NO: 28643 - DNA, 2956 bp, Homo sapiens
cacacacacacatacacagaatcctcagataacaggaggcaataaatccaacagcacatccacgttcagagaacagtgtccctgctgtcttgctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatcccagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattc

SEQ ID NO: 28644 - DNA, 2770 bp, Homo sapiens
ctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtctaccaagttagaagtctaaatgaaacctttcagtgatgtccataatggaaaacagaggcaactttattccatgaagaatgagaccaggagtgtatgtttaggttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaa

SEQ ID NO: 28645 - DNA, 1980 bp, Homo sapiens
ggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcaggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgatta

SEQ ID NO: 28646 - DNA, 3852 bp, Homo sapiens
gagcggcggcggcggggcgctggggcggagactgcgacccggagccgcccggactgacggagcccactgcggtgcgggcgttggcgcgggcacggaggacccgggcaggcatcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctgaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgtgaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgccactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatg

SEQ ID NO: 28647 - DNA, 3671 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaa

SEQ ID NO: 28648 - DNA, 3462 bp, Homo sapiens
ccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaa

SEQ ID NO: 28649 - DNA, 3068 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaa

SEQ ID NO: 28650 - DNA, 3105 bp, Homo sapiens
atccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattagctgggcagcgtggtgtgtgcctgtagtctcagctacttgggaggccatggtgggaggatgggttgagcacaggagtcagaggctacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacagtctcgctctctcacccaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaa

SEQ ID NO: 28651 - DNA, 594 bp, Homo sapiens
gcgggtgcgtggtcgtgcggcaagtgagcgatttggtgaacagacactcccttctgtagtgacaaatgagatcctctattgggctttatgtctaaagcttgcatttcaagcaatttcctcactcgaggtcaggagttcaagaccagcctggccaacatggtgaaaccccatctctactaaaaatacaaaattatccagtcatggtggcaggcacctgtaatcccagctacttgggaggctgaggcaggagaatggcttgagcccgggaggcacaggttgcaatgggctgagatcatgccactgcacttcagcctggacaacagagcgaccctccatctcaaaaaaaaaaaaaaaatcaggttttcatcgcatcaaggatgctaaaaagaataagcatcacttaattttctctttgtttccatttgatcagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgag

SEQ ID NO: 28652 - DNA, 852 bp, Homo sapiens
aaatgatatctgtcttacagttattatgtagatttaaggagatagtatgcagaaaagcatcatacaacaaattagtttccttcctataaatgtatctcagagaacttagccacatgcaggaccatcaaaaatctataaacattacaataaggcaaagcttgagctaaaatgtggaggaattagtgaattttcctgtgcacatgataattcacatgagatagcaagatgttttcaaatatagctgccatacaatgattgttttttgttttttgtttcttctgtgcagtgacaaatgagatcctctattgggctttatgtctaaagcttgcatttcaagcaatttcctcactcgaggtcaggagttcaagaccagcctggccaacatggtgaaaccccatctctactaaaaatacaaaattatccagtcatggtggcaggcacctgtaatcccagctacttgggaggctgaggcaggagaatggcttgagcccgggaggcacaggttgcaatgggctgagatcatgccactgcacttcagcctggacaacagagcgaccctccatctcaaaaaaaaaaaaaaaatcaggttttcatcgcatcaaggatgctaaaaagaataagcatcacttaattttctctttgtttccatttgatcagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctgg

SEQ ID NO: 28653 - DNA, 3517 bp, Homo sapiens
ccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattagctgggcagcgtggtgtgtgcctgtagtctcagctacttgggaggccatggtgggaggatgggttgagcacaggagtcagaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaagagttgttaacattttttgatgaattctgctgaaaattatctgaacatacctgtttttcgaaacttcaagaaacttcaataagggatgcattgagcagtctgacagtgagaataaagaatgctgagtcaagatttatattaaggctggaagctgtggctcacacctgtaatcccagcattttgggaggctgaagtgagaggttaatttgagggtaggggtatgagaccatcttggccaatatagcaagaccctgtgtctaaaacaaacaaaaaaatttttaattggattttgatatggtttggatctgtgtccccaccaaatctcacgttgaagtgtaatccccaatgttagaggtggggccggctgggaggcgactggatcatgggtgtgaagccttcatgaatggtttggcaccgtcccctcagtgctggtctcatgacagtgagttatcgtgagatctggtagtttaaaagtgtgtagcacctccccactctctctttctcctgctttggccacgtgaagatgcctgctcccactttgccttctgccatgagtaaaaattccccgaggactccctagaagcagatgttgccacgcttcctatatagcctgtgagctaattaaaccccttttcttacaaacta

SEQ ID NO: 28654 - DNA, 563 bp, Homo sapiens
attgctcttggcagctctgtctgaaggaggaggacaagagactccagggtatggaaagggattttcatagtggcgggcagcaggaaggagcagaagttggacctgaaggcaggaagccagcttggttctagaaagaaagaaactgggggcacagaaaaaaacagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagcc

SEQ ID NO: 28655 - DNA, 1954 bp, Homo sapiens
gggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagaggttgaagcatgccacaattaagacaacaaaggacagatgcagggtcagaagcaactcaatgaatccactgggttctgcttctcgagccactgtggaccagttaacagaccttccctccaaggagcagctcagttgtgtggtctttgctctgtggcctcctgctttctccagcaacctcagtgatccaggtgtcaagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcat

SEQ ID NO: 28656 - DNA, 4368 bp, Homo sapiens
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaa

SEQ ID NO: 28657 - DNA, 7003 bp, Homo sapiens
ctgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtactacagtgcaaccattctgcagatgtctggtgttgaagatgatagacttgcaatatggctggcttcagttacagccttcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctacaagatgaacaaatcaactgtcattgactcctcctgtgttccagttaataaagcatctacaaatgaggcagcctggggcaggtgtgaaaatgaaaccaagttcaaaacagaagatatattttgggcttacaatttctgccctactccatactcctggactgcacttctgggccttattttatatcttgtcttctttgcacctggaatgggaccaatgccttggactgtgaattctgaaatatatcccctttgggcaagaagtacaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaaattgaatcactctttgacaacaggctatgtacatgtggcacttcagattctgatgaagggagatatattgaatatattcgggtaaagggaagtaactatcatctttctgacaatgatgcttctgatgtggaataattttcagctgctcatatatttagttatttaaacaaactggggggagaagaacagcaattggtgacttcactgccctgcttctaatctggttctttccacagcctagttttgattgacttcatattctagaatacttgattaggaggaagatacaaccatgatgactttttttttccacaaggaacaatattttaaaaaatatttacagagattttaatctaataattcttaagcaaatgtgtgtaatgccttcctgaaatagtctaaaatgaatattgtacccagtgacttcagtggtatccttttttcctaagaccatttataattattagtggcaacagagtcagtgctaatctagccaaattacatatgtataatatatttataaaggattctgggagatggtccaagggtgttctgtgtcaaaagatggcctattggccctcagttttcctacagagtagtggcttatctctgatcagctgttacaaactaaattccatgtaagctttcatcaacaaattccaaagtgcctcctacaagggcacagctgtccgtatctcctttggattccatatttttgtttctctccaattcagatattgggagttcttcagatactgactctgcacactatcttttgaacattatgaaaatataatctgtcgggttgttttcatacttcttttttttgcatcagtgataaggcatacatttgcgcagatgagctaggaagttttgagaagtaccttttatgttcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactatttcgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtctttttttactttaagagcataaactcgtttttattttgcacacttttctcattttcctgagaatttaccagaaaaaaaaaagatacatagatttgtctctgtgtttttcttattcttggcttagtttttccttcttgtgtaaaaattgagattgcctattggaacagataattggttctaatatagcacgtctataagaaatgcaggcttaattatatttccacaatgtctttccaaggtattcattggtttttatggtaattcatcactgaactcttaatttttgcttttctattaagaactatatagtatgtacaaaattacttgatcacaaaattacttgctagttccaggaaaaatatgaatgaatcttctgtggccagttaggaatacatcagtttgatgcatttttaaatggctctaaacatctaataaggtactgtatttggagagaaaaggtggctatctccatattcaaaatatttcttccagtctccaagatactctattcttttaatgtctggcttgttcctatcacagttatcaagctgagaatacagctgaggaagttcattctctaagtcaccagaggtataatatgtgcttaaactgtcaatttagtgccctaaaaatccattaaccaaaaacaaaaacgttttctccctttggtcatttcatataataaaaaaaattaatattttatagaggttttttccttgaattaggtgctttaacaattgatttccaagggaatattagtattgattttttcctcagaaaagcagatatgatttaatagggaaaattattattctattgatatttcttatctcataagaaatttcttatctaatattttacacaggtaaattgaagtgaaaaataagctactatatggtacaatcaaaatataataaggagaaaaagtagaccaataaagtgctctctaaaaatttattttttggacttaatcaaaataattgcctcaatccttctctttattgtatatgtagccttaactaactatatacttataaactcagctgggctgatgcacagtaactttattaaaggagaaactggactcttgttatttcctaaagcagaacatggcctgttctccctgatataagaaaacaatgttttcaactttataaccataaatgcacataataacagggaaaattagccacagttctcctcccctactcccctgagcccctactttaaaggactatttgttatttatatagtgttaaagataatattccatatctttgaagtataagacagagaggcacagtataagaattatttataactttttagaaacaattacttgaaaaggaaccttatacaattagggtattatttttagatttggtgaacatttatagtatattaaaaattaaatgtttaaattttgcaggtttttttatattaggcaccttttaagttcccagcatatttggctaccactatcaacttggaaacattccatttgtagtatcatcaaatatatattttgtaggacaatttatatatgatgtgatttgacctaccatattaaagcagacacagattacgtatcatgctttcaaccaaaattacagacttcctttgaaacatgctgcagatttgatagaggtatattatgtcttaggaaaatacaatgaagaaggtccaaatccctattgaggctggatgtctgatctgcactagacttaagaggatatatcatttcatctgcatataaacacatagggctgaatgtgatgtcaaaagggtttgccgttaataattttcttcaatgtaaacattcctaataattttgattgttgctccttagtcaatcatttcccaaaacatgattatttttaatatatgtaaaatatttaaataataaataataaaaggtaatgtgtccattttaaattttgttcccagccatacacagtagttccctgatacaaaatgctatgagaataccgactattttttcataatttaattttaccactgaacctgattttagtacataagagtctaaatattaagttattcactctaaaaggggaaatcagtaaaagcaaggaatttatgaaatttttgctgtaatttcagtatctgttatacaggggaagaatgatcaggaaaaatataagctgacaacttacccttttgctttttaacaacaaaataatattgaaaatatattagaataactcacagatccagaagttggtggaaatggaagaatgttttagaaaataccatccatatgtttatctaagaaagtctcagaatttagtgacactaatacagttcataaatactgtaatacagtggagagagttggaatgttattttggttttatttcatcagcacaattattaaaaacaacaaaattaatgagacgttttgttataatcagatttttttttaccatattgcaagttataaaatgtcaacttatactaagtacctaacaactgacttttattcacttgttgtgacaagtttttaattaccaaattaagaccttttcagtatctatgagtaaaagaaatagatgattatatcagaccaggagcagagaatttataatatgtgctttatagcaaaatgtattaaattgtggttaaaatttatagctcatatgtagctgctgccaataagaaggctcagaattgttctgtggattaatttttacatcctgttttctgtcacttttaccaatcttcttggcctcatgtacaataatgtaaagccaatttgatgaaatggttcaggttgtagcagtctataaattgtcggtacattcagctcttctaggtgagcaatactgctgctatttttctagaaatagcaatcatttaaaaatgccaaatagctaactgctaccaactctttcttgtatcttgtctctttagagaaggaaatttttgtgtgccagtaatcatcaaagaggtgttttataagagtgttgatgttcagaagttcatgaaagtattttatccgtataatttgctagtgagctaaaacaatataatttatgtaaatctttatatgtacaaaatatatagtctgttgtacttgagtaatttggtctatggaattttaaatgccttcatttagcagtaatattcacatttttattttagacagttaagttcatgtgtttgattttgtcatgtcagcataaatgagaaaaagaagtggatcatgcagctaatgagtaaccaacattttgtaaagttttaaagttttagcaaacaacattattccatctcatttaaaggttaaaaaagaagagacaactctagccaaagtagaaatttatattctacacgtccaaactgtctcctagcagcttttggactatatatcacttgatgttaaagtatcttttatttgtaataaatattcaaatttctatttagaagctctaatgtatacctagattaaatcaaatcacagttttatgcttttaaaatatatgtatttcaaactgtatattttaatttctgagtgcatgttatatagtatttaatacttcagatgtcttggcaaattcaatataagtatttattcccacaagcgatatatgggatatctcttaaaaattatgaatatgtaccatttccttcaaagtcatcctagcctatgctgtatcaaaagtattgtatattttatggagatttagtgatatacatgtaaatgttttttaagttattttattgaagttcaatctttacataaaattaaaatctttttttaaaaaaagtgtcagtgccagaactgtaaatgaaaataatcaaataaaagttaaaataattcattactcattaa

SEQ ID NO: 28658 - DNA, 3082 bp, Homo sapiens
cgcctcccgcccgctccgcagcgccagctcggcaggcgcggggcgtgagtgtggagtgagacccgccgggctccaactccgcagcgtcggagcgcggcgggcagcaactttctccccggagcggccgtggcggcggctgctgccgtggcagccggagcggaagccgggaggaagaaagcggcggcagcggcggttgctcccgccggctcgggctgtctagctcgccgagactgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtatgtatttctttctggctttttactgaaaagattgtgaaaggattattttatgtgaaatagtgaaaagtatttcatgtaaatactagactcagtgatttgttctgattaaatgtatgaattctccttttgggagatactgactttacaattttttaattccagtaatttgttactagataaaggtgatttattttgtttgttatatgattggctttatttgattccataaaatttctcttttacgccatccaatacctccttgtattctgagcttaaatgtgtcattttttctaagccatttcttgatgctggttggaaagcaaaatagaaggaaatcacctggcattgccagagattatgggcacacagataactaattcatttctttttggtgcagtctactacagtgcaatgtgataaggacattagtagaagtacgtttattataaccagagtatggtagaggggagattgagtgggaaggagagtgaggaatacagaaaaattccctgttctctaattttaagagtaattcccaaagctgtatgtgtgctgagggtgggaaggactaaatattaagggctctactaggtttccctcattcagtattaaacccatttttgagggcctctgttgcactagacctacagcagtaactaaaatagacctgggtcttgtcctcatggatgtacaggctggtagaggaagcacacattaaataaactcacagttaaatataagatttcaaactatgataagggccatacaggactctctcaattctctacagagtagacttttaagatcctaaatcataaaatacagtttagagaaggttatgtgctttcccagggcacatattgttagattaaaagctgccacatcttagaagtcctccccactccctgcctattgattgaatttttttcattaagaaaatacaaattatgtaaaattaaattttctttggtaaaccatttgtatttgagactcttgattttttttaattacttgagatatgatgagttatttagtgactgtttgagaagagtgaattgattaaaatatttttaaaaaagaaggattaggacccaatgagccagtatattaaatcaagatttgttgagaaactccattttctatacattcacacactttgtggatttgactttaatcataatccctgttgaacttcaactttcgagactacatgttcaatattttgttctctcctgcttctctctgacattaactttcattttttctcacctttaccagctctattaaggcccatctgttggtctagtgccaggcacgtttgattgcttgttctctgaatttggcacatcatgacttgttctgagatgtgtccaccttctgcagtctggtggaagtatagaattgcagctaggctaggaccaagcatcaaataattaaatccattaataatcctatgtgaattcgttagttgaccaacctaatatttgttctggttttgaaaatatgttttgtttgttatgctttttttcctaagcatttaaacttgacaagtataaaagcatagaaagtgaaggatttttcttgtactttttttgttttcacttaaaactggtatcacaaacagagccaactctagtttatgggtagtgactggggccagtgtattcctagtttgaaatgactgtcataatccattagcagtagctagtgtaaattgagctgattgatgctgtcaaattttaataaaacattcatttctccaaa

SEQ ID NO: 28659 - DNA, 3699 bp, Homo sapiens
gttgagcgaagccgcggggcccaaccgcagtcgcggggtctgggagccctctattggagattctgcctcccctgggacagatggcttcttgagcacactcccacgatgggtggctgctctgggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatgaca

SEQ ID NO: 28660 - DNA, 2335 bp, Homo sapiens
ggacccctgctctgaccgcaggtgggtgcttgtcttgcttacggagggctcccgatgaaccgagtcacgttttgtaaccacattaacggaccattcaaagtcgaatcctaggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttatttttta

SEQ ID NO: 28661 - DNA, 3458 bp, Homo sapiens
agttagtgggtcccaacggctgcaggcggggccggcgggggcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgta

SEQ ID NO: 28662 - DNA, 533 bp, Homo sapiens
agcagccgccggggctggaccgtgcggtgcgcaggtgagaagccgggaggggccggacaaccccgaccgcgagccggacccctgctctgaccgcaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgatt

SEQ ID NO: 28663 - DNA, 1732 bp, Homo sapiens
gttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttg

SEQ ID NO: 28664 - DNA, 561 bp, Homo sapiens
gtgcgccgcgccgtccctgcggccggggggtgcgggaatgaggacctgagctggggtagaggtggccgagctagagtagaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatg

SEQ ID NO: 28665 - DNA, 665 bp, Homo sapiens
tttttagtaaagactgggtttcgccatgttggccaggctggtctcgaacccctgacctcaagttatccgctctcctcggcctccaaaagtgctaggattacaggtgtgagccaccgtgcgcggcccgaaataactctttacaggatctcgccctgggccttcccagcccagccggcccgcccgcggggatagcccgggcactatctccctgctgcaggcggtgaggggctcgggtatctttgaaaatagatacgttcacaccctcctaacggcggcgccaagggtggtgggtcccaaaactgtttccccgtaaagagttcccccgcccggtcgcaggaagacgcctgagggggcgctcggagggatccccagcagccgccggggctggaccgtgcggtgcgcaggtgagaagccgggaggggccggacaaccccgaccgcgagccggacccctgctctgaccgcaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttga

SEQ ID NO: 28666 - DNA, 548 bp, Homo sapiens
gggggcgcagcggcccgggagccctctattggagattctgcctcccctgggacagatggcttcttgagcacactcccacgatgggtggctgctctggtacatctcatccacttcttcatctgtgaagctgtcacccatggtggtgagcagctcctggaggtggtcctcatgaatgaaacctgaggattcctcgttgaagcaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatgtcaccccagctctgatctttgccatcacagttgctacaatcggctctt

SEQ ID NO: 28667 - DNA, 578 bp, Homo sapiens
ggcgggggcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttg

SEQ ID NO: 28668 - DNA, 1873 bp, Homo sapiens
acaacctgacttttgttcacaatgcaaagactccaactgttgagagtagaagtactcctgggtgtgaaacaaggagatgaaatgcggcatttctttttttcttctcagacctccactctggagaagagtcagaatgggggcgtcggggaggaggtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttca

SEQ ID NO: 28669 - DNA, 1650 bp, Homo sapiens
gtatctttgaaaatagatacgttcacaccctcctaacggcggcgccaagggtggtgggtcccaaaactgtttccccgtaaagagttcccccgcccggtcgcaggaagacgcctgagggggcgctcggagggatccccagcagccgccggggctggaccgtgcggtgcgcaggtgagaagccgggaggggccggacaaccccgaccgcgagccggacccctgctctgaccgcaggtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaa

SEQ ID NO: 28670 - DNA, 1613 bp, Homo sapiens
aggtcaccccagctctgatctttgccatcacagttgctacaatcggctctttccagtttggctacaacactggggtcatcaatgctcctgagacggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttg

SEQ ID NO: 28671 - DNA, 682 bp, Homo sapiens
tgaccgcaggtgggtgcttgtcttgcttacggagggctcccgatgaaccgagtcacgttttgtaaccacattaacggaccattcaaagtcgaatcctaggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggg

SEQ ID NO: 28672 - DNA, 580 bp, Homo sapiens
tttggcaggagacctgaatgaaatgagggagccttgggagcatgatccaggcggagggaactggattcgggaggaggaactgccttggccttgaaagatacctaccaggagttcaagtgctgtgcgggtgcatcagctttgtagatttgtgcaagatgaaaattggaattgtcttaggaaattatggatcattcatttattcagtgctggattcattcagtgatttatgtctgaagtgtgacagaaggggagtaaggccaagtgtccttggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactct

SEQ ID NO: 28673 - DNA, 4125 bp, Homo sapiens
agtcgcggggtctgggaggagacctgaatgaaatgagggagccttgggagcatgatccaggcggagggaactggattcgggaggaggaactgccttggccttgaaagatacctaccaggagttcaagtgctgtgcgggtgcatcagctttgtagatttgtgcaagatgaaaattggaattgtcttaggaaattatggatcattcatttattcagtgctggattcattcagtgatttatgtctgaagtgtgacagaaggggagtaaggccaagtgtccttgccctctattggagattctgcctcccctgggacagatggcttcttgagcacactcccacgatgggtggctgctctggtacatctcatccacttcttcatctgtgaagctgtcacccatggtggtgagcagctcctggaggtggtcctcatgaatgaaacctgaggattcctcgttgaagcaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatga

SEQ ID NO: 28674 - DNA, 854 bp, Homo sapiens
gcagcggcccgggaggtgcgtggttgagcgaagccgcggggcccaaccgcagtcgcggggtctgggaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtg

SEQ ID NO: 28675 - DNA, 3915 bp, Homo sapiens
gtggggtggggtggggctgggggcttgtcgccctttcaggctccaccctttgcggagattataaatagtcatgatcccagcgagacccagagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttaactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacga

SEQ ID NO: 28676 - DNA, 1481 bp, Homo sapiens
agagatgctgtaatggtaagactttggatccttcctgaggacgtggagaaaacttgctgctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcat

SEQ ID NO: 28677 - DNA, 3359 bp, Homo sapiens
ccgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatcccctttcctccccaccttccccagactcagctccagaataccttcttcgctgctagagaagggggattggagggaagacaggtctagactttctcagtgggacaaaccagagcagagagcaggacaggagacaagaaatccagtttcccaccaccttggactcctcccacaatctgggactttcactgaattcttgccacgcagactctgggcaaaggggtttttttttttttttttttttttttttttgagacagtctcgctctgtcgcccaggctcgagtgcagtggcgtgatcttgcttcactgcaagctgtctcccaggttcacgccattctcctgcctcagcctccggagtagctgggactacaggcgcatgccaccacacctggctaatttattttgtatttttagtatatacgcggtttcaccatgttagccagaatggtctcgatctcctgacctcgtgatctgcctgcctcagcctcccaaagtgctgggattacaggcgtgagccaccgcgcctggcgaagggagttctctcttgacccctgcagggaaaaggactcacctccctcactgcaggctcagccttccagggcaagagggaacaggaaagtatgtgcccatgtgtggcaagatggaaggacggcaggctcccgcctctaggcttggggctctaccccgatggtttcccaaggctgccaagaaggagccctaactttcttcctctcccttcctggaagggtgctgcatccacaggcttttgaccaactaaggcaaagaggggatttgaaaggctgcctggaaacactgggctgggaggagcctttggatatttttatatacgtttgaaaaggggattgagagaagaaaccaaaggtcggttgtactaaatgtatatatatagatacttctataaagtcactgctgaagacaagcatcctattgtggaggtacttgaggatgggctgagacagggaccataactcttcacccctcttcctccctctgtcctgcctcagctcaaggcctcagaatcttctggatgccattgctcatgcccctactcacatttctactcgttgctttattaatagtaaatgctcaataaattgtagctgccagtgccgggcattgctcttggcatttgcagaatactcactctgtgagggaggtgtcagcccatgtcacagatgggcagtgaaacccatgataggggcactcttcaccagggacacagctggagacatggcagcaaggatgccaggccctgcccacggccccacatcccctcctccccaccttcaacagtgagttactagcgattctccaaaacagaagagatggagaccaagaccaca

SEQ ID NO: 28678 - DNA, 1852 bp, Homo sapiens
gattccaatcctaccaaaaggcagagtgggtctggagggcctttcggggcacaggcagcaagtggattctgcgagccagggttcacccccttgcctagtaggcggcgcggcgctccggaatcggggacaccctgccctcgatccgactcgggaaagcagatccaggcgggtcttgccctccgggagctgtccgtccgtcttcgctcacgggcagtgtttcgaggaccggaggctctccgtgggcccccacccccactcctggccgccctccaggacgctgaactttcccttggccccatggatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaagggagctgacctagattggatagtaactgaggtgtctgaaacgcaccagtggcataacttaccttactccaagaataaaatgatacactttgcattaatact

SEQ ID NO: 28679 - DNA, 2301 bp, Homo sapiens
ctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcaggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacctgt

SEQ ID NO: 28680 - DNA, 2528 bp, Homo sapiens
cggtgccctcggagctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacctgt

SEQ ID NO: 28681 - DNA, 588 bp, Homo sapiens
cgagagagacccggccatgcaggagccgctgctgggagccgagggcccggactacgacaccttccccgagaagccgcccccgtcgccaggggacagggcgcgggtcggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggggctgactctcccatctcggccgggcctaggaaccagtattttcagcaaaacctggtgcggcggctgtgtcttgcaggtgtacgtgtctgagattgctcccccaggcgttcgtggggctctgggggccacaccccagctcatggcagtgttcggatccctgtccctctacgcccttggcaaggacgaagaggccctgcgggcgctggcctggctgcgtgggacggacgtcgatgtccactgggagttcgagcagatccaggacaacgtccgg

SEQ ID NO: 28682 - DNA, 727 bp, Homo sapiens
ggagctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttgggacgaagaggccctgcgggcgctggcctggctgcgtgggacggacgtcgatgtccactgggagttcgagcagatccaggacaacgtccggagacag

SEQ ID NO: 28683 - DNA, 1539 bp, Homo sapiens
atggagaacaaagaggcgggaacccctccacccattccatccagggaggggcggctccagccgacgctgttgctggcgacactgagcgcggcctttggctcagccttccagtacggctacaacctctctgtggtcaacacgccgcacaaggtcttcaagtcattttacaacgaaacctactttgagcgacacgcaacattcatggacgggaagctcatgctgcttctatggtcttgcaccgtctccatgtttcctctgggcggcctgttggggtcattgctcgtgggcctgctggttgatagctgcggcagaaaggggaccctgctgatcaacaacatctttgccatcatccccgccatcctgatgggagtcagcaaagtggccaaggcttttgagctgatcgtcttttcccgagtggtgctgggagtctgtgcaggcatctcctacagcgcccttcccatgtacctgggagaactggcccccaagaacctgagaggcatggtgggaacaatgaccgaggttttcgtcatcgttggagtcttcctagcacagatcttcagcctccaggccatcttgggcaacccggcaggctggccggtgcttctggcgctcacaggggtgcccgccctgctgcagctgctgaccctgcccttcttccccgaaagcccccgctactccctgattcagaaaggagatgaagccacagcgcgacaagctctgaggaggctgagaggccacacggacatggaggccgagctggaggacatgcgtgcggaggcccgggccgagcgcgccgagggccacctgtctgtgctgcacctctgtgccctgcggtccctgcgctggcagctcctctccatcatcgtgctcatggccggccagcagctgtcgggcatcaatgcgatcaactactatgcggacaccatctacacatctgcgggcgtggaggccgctcactcccaatatgtaacggtgggctctggcgtcgtcaacatagtgatgaccatcacctcggctgtccttgtggagcggctgggacggcggcacctcctgctggccggctacggcatctgcggctctgcctgcctggtgctgacggtggtgctcctattccagaacagggtccccgagctgtcctacctcggcatcatctgtgtctttgcctacatcgcgggacattccattgggcccagtcctgtcccctcggtggtgaggaccgagatcttcctgcagtcctcccggcgggcagctttcatggtggacggggcagtgcactggctcaccaacttcatcataggcttcctgttcccatccatccaggaggccatcggtgcctacagtttcatcatctttgccggaatctgcctcctcactgcgatttacatctacgtggttattccggagaccaagggcaaaacatttgtggagataaaccgcatttttgccaagagaaacagggtgaagcttccagaggagaaagaagaaaccattgatgctgggcctcccacagcctctcctgccaaggaaacttccttttag

SEQ ID NO: 28684 - DNA, 1447 bp, Homo sapiens
atgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatc

SEQ ID NO: 28685 - DNA, 914 bp, Homo sapiens
ccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagc

SEQ ID NO: 28686 - DNA, 1937 bp, Homo sapiens
atgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaacaaaaaaaaa

SEQ ID NO: 28687 - DNA, 2172 bp, Homo sapiens
attggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaacaaaaaaaaa

SEQ ID NO: 28688 - DNA, 506 bp, Homo sapiens
gcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagag

SEQ ID NO: 28689 - DNA, 793 bp, Homo sapiens
ggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcag

SEQ ID NO: 28690 - DNA, 933 bp, Homo sapiens
caggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctc

SEQ ID NO: 28691 - DNA, 1030 bp, Homo sapiens
cagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatgctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaaga

SEQ ID NO: 28692 - DNA, 854 bp, Homo sapiens
caggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccct

SEQ ID NO: 28693 - DNA, 992 bp, Homo sapiens
ggccggtgcgggccgcactcgcagggcccgtggcggttcaggcgccagagctggccgatcggcgttggccgccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcag

SEQ ID NO: 28694 - DNA, 1850 bp, Homo sapiens
cttggcagagtctggggtccctggactgagccatcagctgggtcactgagacccatggcaaggaaacaaaataggaattccaaggaactgggcctagttcccctcacagatgacaccagccacgccgggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaa

SEQ ID NO: 28695 - DNA, 1866 bp, Homo sapiens
gttggctctagggctggcaccaggcactggaattaaacattctggactccagaggggcatgaaaactcttcctgaaggagatgcagaggaagattcgaactggaggaaaaccctaaaataaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatct

SEQ ID NO: 28696 - DNA, 1927 bp, Homo sapiens
ccatgaagagttctagcaccaagtcagtgcaagacccgaggtgttcctgttggctgagtgttggctctagggctggcaccaggcactggaattaaacattctggactccagaggggcatgaaaactcttcctgaaggagatgcagaggaagattcgaactggaggaaaaccctaaaataaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaa

SEQ ID NO: 28697 - DNA, 738 bp, Homo sapiens
catggacatgaatgtgtggcttaaattacattgctgtgtgggcatgaatcagacgctctgcccatgaagagttctagcaccaagtcagtgcaagacccgaggtgaaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaag

SEQ ID NO: 28698 - DNA, 2344 bp, Homo sapiens
ctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggtgagttcaggacatctcgggagcacccccaccccttcaccactacccttggccccctccttgtgttccaaagccaccaccacaggacaggactttctgcagactggtctcttctaacaggctggatgtccttggggggcccatcctgtcccgagccaacatagcaggccatggacaaaggcgcgataagggactggccagcgtttactatctagtccctcttaggagatggatgaggtggctttgagtgatgggcttccctgcctgctcagcagctgtccatatggaggcccgtggcatagcaatgacagccaccagtgtgccaggctctgtgcttggggcggacccagcatcagttcataggaccctcccagcaacgctgctgcctgggactcagtgattatcccattttgcagaccagaaagagaagtaccaggagtgagggtggcctggccccatgggggaggtggtgaggacatcccagaccctgcctccaccttccccaagacagcctggggcctggcatgcggcaggtgcacagacacctgtaaccggggttgtttttgcacgactttccctttaaactatcatcagtcatcccgtcagccaaaacataagccagttcccgccagggttctacacaccgtctgcaagtcagtcaagtggatcatcaagctctgtgctgcttagacactctctgtagaaagtgcttaccgtgagccaagtgccaagtcttttttagtaactcatgtattcctcagaacagccctattaagcctgtaccagtatcatacccattttgcaggtgcatcacaggtacagagagattggaagactggtccaaggtctcatgaggatgcagacccagcggcacagacctaggtccctgtttaagtaccacatgctcctgcctctccttcactcctgcatgtgttggggacacttacgccaaggcgccgcgttctcattaggagctgggaccagaagtgaataagccaggttcctgtctcagggagctccatagcaggactcagaaccacacacggccctctaggcatttgtgaagctctgtgcttcatttttttgctttgcctctagttttgcctttgcagtaccaatgcagccagcccatgtgtcccctctatgtggaatgttaacgatattcccactgtttctggtgtcctttctgtaatcagagctgccgtgaccattccagttcaggcatcctggtggcctggcttctctgggcatagagctgggagtgggcagttgggtcaggccgggtatgcccagctcctccagcccctgcaagactgtcctctgaaggacacggggacgttctcaccagcacatggtattaccggcctcgtcggtgtggtctgtctgatgggcgcaggggtgcgtcgctgctgatccctgctgcaggtgtttcccgagtgtccaccgtcgggagttgctgttcttagggctgggaaagctgtgccctcctggagcctgcaccccactcaggatgacggggctggggccggctctgcagagggcgccttcggggtggtggggaggccgctggtgccagctcgctgccttcctcccaggctggccgatcctgctggggctgaccggggtccccgcggcgctgcagctccttctgctgcccttcttccccgagagccccaggtacctgctgattcagaagaaagacgaa

SEQ ID NO: 28699 - DNA, 4165 bp, Homo sapiens
gaagtgaaaggaagaccaggttcctgaaagggttattctgacttaatctggctataaaaatgctattggctgttatttggcatggccaaagtgcacccagaatgtcttctctctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaacttggtggccccgacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaacaagacgtgctgctgttctttgagcaagtagaaggcaggaggaagttccctgctcattcaggcagtgttttttttgtttttatttttgcttttttttttttttttaagacggagtctcgctctgtcacccaggctggagtgcagtggtgcgatctcagctcactgcaaactccacctcccgggttcacaccattctcctgcctcagcctcctgagtagctgggactacaggcgcctgccaccacgcccggctaacttttttgtatttttagtagagactgggtttcactgtgttggccaggatagtctcaatctcctgacctcatgatccgcccacctaggcccctcaaagtgctgggattacaggtgtgagccactgcgcccggccacttcaggcagtttgactgcacgagtgtcagttccttgagggcaggggcttggtcagttttgtttatgcctgaatccccagcatctcgaagagggcctctggaggctgaggtgggaggattgcttaagcctgggaagtagaggttgcagtgagctgaaattgcaccctatactccagcctgggcaacacagtgagatcccatctcaaaaaaaatttttttaattgggcatggtgacacgcctttggggtcccagctatttgggaggctgaaatgggaggatcgcttgagcctgggaggtcaaggctgccctgagtcatgattgcatcactgcacaccagcctgcatgacagaatgagaccttgtctcaaataaataaatacatgtaagattgaggaagcttccaaatgtcctcacatatgtaatgaaatcttgaggagtcttaaaatcttgagactgtggtgggggaggaagggaaaaggaacagggtcttgatatggtttggctgtgtccccacccaaatctcatcttgaattgtagctcccataattcccatgtgttctgggagggaccctgtgggagataattgaatcatgggggcaatttcccccatactgttctcatggtagtgaatcagcctcatgagatctgatggttctgtaaggggtaaaaccttttgcttggttctcattctctcttgcctgccaccaggtaagacgtgccttttgctttctggcatgattgtgaggcctccccagccatgtggaatggcgagtccattaaatctctttttctttgcaatttacccagtctctgatacatctttatcagcagcatgaaaatggtctaacacaggtctctccccaaaaatatagagagctggaggtttttcttagagatatgaataaagggtgtgagtgtgagtgtatgtgcaaaaatatggataaaaccttgaaagtgctgaatggcctgtagcaagaagtgatgtcttctcatagatgggtggcagaggctggtggccgggagagagagcagtgggacttgggagcactttttgtgggtatgtaatggagattccaccagcaacaagctaaaccactcacaagcgggcccagaggaagtaaacagaacactgtggttgaaccatccttggccttctgcagcaaggatctgcagcctggaaggggcacagaaacaaccaaagatgaaggctctcagagctgaggagaggccaggtcagaatatcagaagtcaagaaactgcagcacctctaacacaggggaggctatgaagttcatggttctggatgtctgctccctgggttcaaaccttggtcctgccacattagttgtgcaacttggaaagttacttggcttttttgtatctcagtcttctcttctgttaaatggcactaatagtaaatgtctcacatgtccattgtgagaattaaatga

SEQ ID NO: 28700 - DNA, 2140 bp, Homo sapiens
gtttgactcttttcatcaacaccagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaacttggtggccccgacaggtcttccggggccatgggcatttgtttagagccaaattcatcctcttaccagatccttttccaga

SEQ ID NO: 28701 - DNA, 1443 bp, Homo sapiens
agagcaagcatggagcaacaggatcagagcatgaaggaagggaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctggg

SEQ ID NO: 28702 - DNA, 1846 bp, Homo sapiens
agtataagcggctctcacgtgtggcaagtttctcagtgtttaggaatgctggagctccactcgctgacagcttcgtccatcatgagggtcctcatcatgagggctccattgcgagaggcccctccagagaagtttgctttgcttctgtcaggatctccaggaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaacttggtggccccgacaggtcttccggggccatgggcatttgtttagagccaaattcatcctcttaccagatccttttccag

SEQ ID NO: 28703 - DNA, 3381 bp, Homo sapiens
gcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgtcgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatt

SEQ ID NO: 28704 - DNA, 2411 bp, Homo sapiens
atggggttttgccatgttgggcaggctggtctcgaactcctgacctcaagtgatctgcctgccacggcctcccaaagtgctgggattacaggcatgagccaccgtgcctggctgaaagacaaagcttttacaactattcttaaattatcaacttttgatagataatatccttgttttctgtatcttgctttgatactgctttcaaggagataatctcattaaagcattttactaaaggccagtatagtgaatgtaatcacttttacacagaattgtgtcagcatgacaaatgtgactactgagacatcattctgttaacattaaaataagtttgtaggtggtaatggaatatgtggcagttacgatcatgagctaggagagtggaacacttgctgtctttttcatagctagtcataggtccttagcgtgtagtgatctttattatcttccaaggtgaagaaaggaaaaggctcgtatgttgagaagcataggaacttgagtcccgcaggtgttcaagtgggctaggctggtgtgggttttcagatgatcattgagtttttctcccaaatttgtataggcactagcacagtaatcctgtgcacttaaatctggcagcagctgtcaggggtgatgggctggtatggggaacccctcagtccccagaggagggtttacacaatattgcagggggctgttgccctggggttttcaagatgcaccattttatctcctagtgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttag

SEQ ID NO: 28705 - DNA, 3657 bp, Homo sapiens
cgcttccggaagcgggcgactcgcagctccacgcgacgccgaggggctccgcgccgggaccgggcgggtgctcggagtttcggggaccgcacgggaccgagggcaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 28706 - DNA, 533 bp, Homo sapiens
atgatgcaaatcagcgtgttcctgcctgctgcttggctgcagttaattttagccggggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcg

SEQ ID NO: 28707 - DNA, 557 bp, Homo sapiens
atttcctgccggccggtcggtttccggatgaaacgaggagccaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatg

SEQ ID NO: 28708 - DNA, 573 bp, Homo sapiens
cttttcatattcacgtgtactcttaagaaagcgtctgttctccaaactggctttccattctccccgtcctaaatggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaac

SEQ ID NO: 28709 - DNA, 2284 bp, Homo sapiens
cccttttcagttttttgagccggagagacgcagcggcggccccagtgccgcccccgggcgcgaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtga

SEQ ID NO: 28710 - DNA, 2992 bp, Homo sapiens
gtgcttaaaaatcaagtgaatgcctgttgggaaaaagcttactccttctctttgtcagtacttgcaaaaacaacttaaaagaagttagtattattggactgaattcagtaattagcataatcatgatgctatgtattgttcaccagggcacgccccttggccgcatttcccattaagaggacaccgatgttgtcctagtgaataaatcccggcacacatgatgcaaatcagcgtgttcctgcctgctgcttggctgcagttaattttagccggggttagttctatgagttgtaaaagtagaagttagcaagctgaaatgtgacttctcggcctaatgtggtaggatatctattttagacttcagattgtgtttgtgatcaggagagcagtcttctgaagaattgtggctcagttttcttggaaactacttgaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgc

SEQ ID NO: 28711 - DNA, 751 bp, Homo sapiens
gccgaggggatgcaatctcagatcagcagccagcagtgtttgtaaacaacaggagggagattgtgctggtgatgtccaactcacaccaatgaagatcaaccggtttgtgctttgggcagcaggctgcagatggacagtgcctcctgagggcatcgccatgttttagggatccatgttgcaggatacctgtctgcaagagagagtcaaggagggctttttaagcccctggggttcaggcctggcatctgggtgttaagtagagtgaatctcctgaagtccaaactaacatatgacattttaaaatgaggaaaacaaatggctctgaaaaggtctataggattataggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcat

SEQ ID NO: 28712 - DNA, 1387 bp, Homo sapiens
agcagctgccggcccctaggacagagcagggacctcaactacactgatcaccagccccatcggatccagacccggccaccagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacgg

SEQ ID NO: 28713 - DNA, 1622 bp, Homo sapiens
actacagcagctgccggcccctaggacagagcagggacctcaactacactgatcaccagccccatcggatccagacccggccaccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctg

SEQ ID NO: 28714 - DNA, 2143 bp, Homo sapiens
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcacca

SEQ ID NO: 28715 - DNA, 2151 bp, Homo sapiens
gaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcg

SEQ ID NO: 28716 - DNA, 2093 bp, Homo sapiens
aaaaactgcccatgcaagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcacc

SEQ ID NO: 28717 - DNA, 1560 bp, Homo sapiens
atggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctga

SEQ ID NO: 28718 - DNA, 1521 bp, Homo sapiens
atggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctga

SEQ ID NO: 28719 - DNA, 1822 bp, Homo sapiens
atgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagctgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagaggtgtgtgcacaggactgtgtctgtgtacgtgtgataacatgcatatggatgcaggtgctcagatacctgacaccttaggattcagacaggaaactatatctgcacatgtgtacttggtgcatgtatgtgtgcgtgcacaggtgagtgtttcagggtgcatgattgggggcatgtaaactgcaagcataaatgtgtacatgagtgtatgaacacaaatacataaggttgttcaggaa

SEQ ID NO: 28720 - DNA, 2555 bp, Homo sapiens
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagctgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagta

SEQ ID NO: 28721 - DNA, 2549 bp, Homo sapiens
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagctgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagta

SEQ ID NO: 28722 - DNA, 658 bp, Homo sapiens
attgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagctgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcac

SEQ ID NO: 28723 - DNA, 933 bp, Homo sapiens
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactgg

SEQ ID NO: 28724 - DNA, 846 bp, Homo sapiens
tgggagctctgctgaccaaggggctaggggctcacctcctatgccatcacccagctacctcatcatggtagccttggtccctgaacactaatgggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactgggtgaggcagagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctg

SEQ ID NO: 28725 - DNA, 2178 bp, Homo sapiens
agcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactcta

SEQ ID NO: 28726 - DNA, 1744 bp, Homo sapiens
agcttgttagagctgagctgccctactacagcagctgccggcccctaggacagagcagggacctcaactacactgatcaccagccccatcggatccagacccggccaccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctga

SEQ ID NO: 28727 - DNA, 2135 bp, Homo sapiens
agcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactct

SEQ ID NO: 28728 - DNA, 3860 bp, Homo sapiens
atctgcctgactttcacttttggtgctggagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagatacaggtgtccaggttgtgcactggcccgaggcacgcagccaaggaggcgtgtggggtctgaaactcagccccggctacactggccccaccacccaccctagcaaaggctgtgtcctctccaaaaaaaggagctgttttaatcacttttcatttactcatcagtgagggagggcttccagccctatggttacgaagacggccaaacacaccaccaaacaccagacagaggaggctggcagcaggttaccacacacgtgcgcagagcccacgaagatgacgctgcactgaggcatggggcggggtgcactgaggatccgagcgagcagccagggctgcaggaaggcagctttggagcacaaagggggtggggcaactcctggcttctgcgggaaggtgtaatcagcttgtttcatcatgctgcaggctggcgagaaacggagccttacaagcgtagggataagaggaacccctcttggtcccctcgatgagggttgttgggccggggagcctcatccacagggcggagtgaaaggggagaaggggagctcacaggcaggcctgccaaggccttctggctttgccagatgtcaagggcagcacctaatactgaaccttaactttcggctttcaaccaaacggcacccttttgctgtttgttttctggaggggacaccttttcttgattcatgcccagacctcccttgtccaggccatgaaaactctgggatggtcgaggccggctgcccatctcagatgggcaaggaagcaaaagtgcagagtggtggaggggccagcttgcagaaacacggccgaacccggccctgatcctagcccagggctctttccagcacaggaggctcctagccctcgtctccaaccctccatgccactgatatctgtggccctgccacaaagttaccctcatgcccttccctggagaccccactctgggccacctcaatctcaggcccctcaactcacctctttcaccctgtgtacactgggtcaatcactcctgcctcctcacagctcccaaatccacctacttcccttcactctggctacaccctggttcacaccacggttgtagctccaaactggtccctgatgtctacattgcactctgcacaacagccaccatgcttattaagaaacgcaatccaaaccaaatccctccctgctgaaagccctccagtggctcacaataaggatcacacttctccccctgcctggtcaggcagccatgggaccccagcctttcctcccacttcggtaaattttaaaggattcggatcatacaaagaatgttcttgaaccagcatggaattaaattagaaatcaattatg

SEQ ID NO: 28729 - DNA, 2882 bp, Homo sapiens
ccacagcaggtgagtggaggcaggagccacgggtggggccaggccacacagcctgggaggcgcaggggctgggcagctgccagtgacccaagcccacacagagacttgcacagctgccccagccccaaattagggggatcccctggcccaccttctcttggctcagccactctgggaggtgggcacacaggggcaccgaagggagcaggcagccctggcatcccacagccgccaggagaaaaacttaggcctccccaagacctggcacagagcaggccggccctggcccccaagcagaggaggctgcacctccctcgcgtctgtgcctgcctcaacgcgggttaaactttgaccaaggaaatgattgctaaactcgattccataagtgtcaccggtcacactttaattccagtctaaaattaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacaggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggc

SEQ ID NO: 28730 - DNA, 3206 bp, Homo sapiens
ccacagcaggtgagtggaggcaggagccacgggtggggccaggccacacagcctgggaggcgcaggggctgggcagctgccagtgacccaagcccacacagagacttgcacagctgccccagccccaaattagggggatcccctggcccaccttctcttggctcagccactctgggaggtgggcacacaggggcaccgaagggagcaggcagccctggcatcccacagccgccaggagaaaaacttaggcctccccaagacctggcacagagcaggccggccctggcccccaagcagaggaggctgcacctccctcgcgtctgtgcctgcctcaacgcgggttaaactttgaccaaggaaatgattgctaaactcgattccataagtgtcaccggtcacactttaattccagtctaaaattaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacaggtttgggcgcaggctggtgctaacctggagctaccttcagatggctgtgatgggtacggcagctgccttcgcccctgccttccccgtgtactgcctgttccgcttcctgttggcctttgccgtggcaggcgtcatgatgaacacgggcactctcctgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggc

SEQ ID NO: 28731 - DNA, 2522 bp, Homo sapiens
attaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgaagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacagtgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggc

SEQ ID NO: 28732 - DNA, 1948 bp, Homo sapiens
ctacttggttgccttccagatgtttcacacttggacagcaaactgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaagaa

SEQ ID NO: 28733 - DNA, 3737 bp, Homo sapiens
gctgaacagtgctctcgctgaggtcagggggagaagatggcaggggtgaatccttgacgatcacggagtaaggacgagaatgcagtttgcttcccacaggcccctccctcaacatgccaagattcctacctggggcatcaagactgcaggtggggccaagaaaagacatggacactcaaagtcaagctctttgacggggaacaggtgcagacagagcagccttggcttccggctcatgcactcacgatgctggctgcgaatgggaagtccctaaacagaactgagccccctcattcagctcagagcaaacggggctggcagcagcccagggcaccacgaagcagagtgcctctgtgtgcccaacacagccgcagtggaggtcaatggatgtccttgccggcgccctgctttttgcttttttaagaaaataagaagcctgcagctgcggcaaggagaaagaccccgtgggtcgctccttttagactacgctattacacctgctgactatccaatagaaaaaagaaggagaaggaaaatcgggttaactttctggtatttagtttgcagatatgtcagcaggccaccttctctacttggcaggatcacgatgtattaagaatccttttgtccaccaggaaagacaaatttcctgtttgtcttgcatttagatgcaacaacatcatcctaaagagatgcccctgatgtgtgagagcagaaaggggtgatccctttcttccttatcctaaggctcacggccaacacccctataacaaaagacaggttaacaagagaaaagcatgacaaatttatttgatcacgttttacatgacacaggagccttcattcagaatgaagacccacagatacagggaaaactggatggcagtatagaactgtagttggacaaaaagggcagcagcccatgttcgcaggctgaggggaaaacccagcaaggcctgtctgttcagatccgtcttggcccctctgtgcagcactccttcctccaggcaccggggacaagactcctctggaatgcgggtctggatttctttacggcccactgttacacagaaaggcagcggggaagttacagtggtatttctaggctttctggctggctttggggagaaaagagtctggtttccacgagctgctttgaggaagaaggattctcagttctatggcttgccccgggggagaatgatgggtgagagaagagacaggagggcaggagaaggtcagagagagagactttgcttctgaggcctccaccttggggcatggatttctgagccccaacagaccttgacagaaaaatctaggacacaaagatagtggcttggacacacctgcctgcatttacacttgacctgtctgcgacgtaaacactttcctctttccctccagatgggttaaggggaaggacacttcagggttgaaacgcaggaataccagattggatttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagtttctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggtaaggaatatttttcactttgaaatgcctccaaattgttttaatcacagtcatccatagtaaggaagggaagaaaacatgacctcatcccggtattagcgctgacggtgggcagcaatgtgggttgtgtctggtaggttttcctgatcgtgtttttcttgggcaaatattaagatcggtgtagcccctaagcacagatcaaggcaatggcaacctcggcttcacattggaatcacctgggagcttacaaaataccaaagccaaaacccccagaaatactgatttaattgttctagggtagggcttggaaaccaatagttttttaattctccaggtgattcaaatgcatagcccaactagagaactattggtataacttaattgatgatgcatgtagatctctattgtagtacagaactggcaaaaaacaaacaaacaaaaaacagggttgtggggggattgccttttctttcctttttttcttttctacctggagaaaaaataaatttctgaacaagaataattccagtggcttcacagcccagtgacttgatctttattgtgtttgctacctacaggctgctctcagagcttcaagccatgctttctctagtggggaatgcatcttttcagggcacattggatctccacccaggcaaatggagatttacaatcactgacaaaagcaaagctcatgaggaattactttagcaacctttacaatagtgcacaggagaggcagctttgaaatttggcctcattatccttctttccttttctgagtaatcgtgacttttgttgattatcctcatattttccattacatgtaatgactatgtttagttaataaactagaaacattgtccaaatgttgttcgtaacaggccaggagagaagtcaccaagaagggaggccgtactcacttggtcttctggtttcctaaaatttgaattaagtagtcagttctttcgatcccaattgcactagaataccccaaagagagaaataactcacaaccactaataacttgatatagttttactaaataaatcattccattggccaggcacagtggctcacacctggaatcccagcatttcgggaggctgaggcaggcagatcacatgaagccaggagttcaagaccagcctggttaacatggcaaaaccccatgtctactaaaagcacaaaaattagcaggtggtacacgtctgtaatcccaactactagggaggctgaggcaggggaataact

SEQ ID NO: 28734 - DNA, 2597 bp, Homo sapiens
gttataataaacacgacaggcatcctgggagtgagctcagggcatttgggaagtgcagaaggacatgcacccccgctggaggggtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagtttctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtgcttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgaagaaatttttaaaaatacattgattattatctaggttagacttaaagtgaatctcaaataaaagaatcaggaatacaacttaagtgatcatgaggtccttccatatttagattgggtaagcatgaatgtgtattttctacaaaagaccttgagaagagttcaataaaaaatgttagcattat

SEQ ID NO: 28735 - DNA, 1774 bp, Homo sapiens
atgaggactctgcatgcagtttctcatccttacagtaactcaatgagattccagagagtcctctatttcatatgtgccttccagaacatctcttgtggtattcactacttggcttctgtgttcatgggagtcacccctcatcatgtctgcaggcccccaggcaatttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgtt

SEQ ID NO: 28736 - DNA, 1987 bp, Homo sapiens
ggggcggggcgcgctacccgcagtccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagttttaaaaa

SEQ ID NO: 28737 - DNA, 737 bp, Homo sapiens
gcgcagtcgggacacgggcgtccagacgccggcccctagctgggcttctcctctaggcctctggcagcgggacctggcatggtgagcagaggcgctgggctcgctcggagtgcgcctgttgccgggcaggagggacctgattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatg

SEQ ID NO: 28738 - DNA, 1021 bp, Homo sapiens
gcggcgctcgcgatccgaaaacatctccacttcctcctcaccccgcgcagtcgggacacgggcgtccagacgccggcccctagctgggcttctcctctaggcctctggcagcgggacctggcatgattccagagagtcctctatttcatatgtgccttccagaacatctcttgtggtattcactacttggcttctgtgttcatgggagtcacccctcatcatgtctgcaggcccccaggcaatgctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccag

SEQ ID NO: 28739 - DNA, 1213 bp, Homo sapiens
ccgcgcagtcgggacacgggcgtccagacgccggcccctagctgggcttctcctctaggcctctggcagcgggacctggcatgattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgg

SEQ ID NO: 28740 - DNA, 1615 bp, Homo sapiens
ggggcggggcgcgctacccgcagtccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagctcctaggacagcaccttcaggagtaa

SEQ ID NO: 28741 - DNA, 1968 bp, Homo sapiens
gattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagctcctaggacagcaccttcaggagtaataatgcaggcagtagctggcaattaaggaggcactccatggtgggtcatgaaggaatgaatgagtgagtgatgagattaaacctcgttgatgaggaaaagaactcgaagtccagcacaagtaaccaaagatctcaccgagtaatcacagtgacaactgttatgtcaaattcaaatccattaccctctgaaaacagttaggaaattctattctccgaagggttcgttcctttcttgatgtgtcacttatcattatttttaattccttctagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagttttaaaaa

SEQ ID NO: 28742 - DNA, 1233 bp, Homo sapiens
ggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacagagtaggcttcctaactgcttggtacaaaaccagtggattccccacatccagtgctcctcctctctaattcaacccactatctgtgaagtgtcatctggactcattgtgggacttggggattagaggacctgagacaaagatgctgctgccctactgcttgctaacgaagctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcag

SEQ ID NO: 28743 - DNA, 3237 bp, Homo sapiens
gcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttattgtttatttgtttgttgttgtatccttttctccttgttatttgcccttcagaatgcacttgggaaaggctggttccttagcctcctggtttgtgtctttttttttttttttttaaaacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaataaca

SEQ ID NO: 28744 - DNA, 1746 bp, Homo sapiens
atgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgagcaagacagtggggcctacaatgctatgaaaaacaggatgggaaagaagcctgctctctgccttcctgcccagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaa

SEQ ID NO: 28745 - DNA, 2201 bp, Homo sapiens
cgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaaccctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaa

SEQ ID NO: 28746 - DNA, 2098 bp, Homo sapiens
gcaattcactttggattttctaatatcccatttctaagaagaatggcagactattgaacaggtgtattttaggtcacgtggggactgcatccacctgaaaatccaccgttgacttatcaggaaactcagagatcaggatctttcacagagtagtcttttaagaagattcagttgtcaacagctagcagtctctttgccaaataattatatctgtgacttctgaaactatttggctgcctaaagttaaaggacttggggaaagtccttccactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcaatgggctttgatgtgctcctggatcaagtgggtggcatggggagattccagatttgtctgatagctttcttttgcatcaccaacatcctactgttccctaatattgtgttggagaacttcactgcattcacccctagtcatcgctgctgggtccccctcctggacaatgacactgtgtctgacaatgataccgggaccctcagcaaggatgacctcctgagaatctccatcccactggactcaaacctgaggccacagaagtgtcagcgctttatccatccccagtggcagctccttcacctgaacgggaccttccccaacacaaatgagccagacacggagccctgtgtggatggctgggtgtacgacagaagctctttcctctccaccatcgtgactgagtgggacctggtatgtgaatctcagtcactaaaatcaatggttcaatccctatttatggctgggtcacttctgggaggtctaatatatggccatctttcagacagggttggacggaagatcatatgcaaattgtgtttcctccagctggccatctctaacacctgtgcggccttcgctcccaccttccttgtttactgcatactgcgcttcttggcagggttctccaccatgactattttgggaaacacttttattctcagcttagagtggacattgccccggtcacgatctatgacaataatggtgctattatgttcctacagtgttgggcagatgctcctaggagggctggcttttgccattcaggactggcacatattgcaactgactgtgtctacacccataattgtcctcttcttgtcctcttggaagatggtggagtctgctcggtggctgattatcaacaatcagctagatgagggcttaaaggagcttagaagagttgcacacataaatggaaaaaagaatactgaagagacactgaccactgagcttgtgagatccaccatgaagaaggagttggatgcagtccgaattaaaacatccattttttccctgttccgtgcacccaaattgcgaatgagagtcttcggcctgtgctttgtgagattcgcaatcactgtacccttttatggcctgatactcaacttgcagcacttagggagcaatgtctccctgttccagattctctgtggagctgtcacattcacagccagatgtgtttcccttttgacactgaatcatatgggtcgtcgaataagccagatattgttcacgttcccggtgggacttttcattctggtcaacacctttttgccccaagaaatgcagatcctgcgtgtggttttagcaactttgggaattggtagtgtttctgctgctagcaacagtgcttctgtccaccacaacgagctcgtccccaccatattgaggtcaacagttgcaggaatcaatgcagtgtccggtaggactggggcagcactggctcctctgttgatgaccttaatggcgtattctccccacctaccctggatttcctatggagtcttccccatccttgctgtccctgttatcctcctccttccagaaaccagggatctacctcttcctaacaccatccaggatgtggaaaatgaaaaagattcaagaaacataaagcaggaagatacttgcatgaaagtaacacagttttaa

SEQ ID NO: 28747 - DNA, 1230 bp, Homo sapiens
gcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctgttctttgcagttggcattgcccaatatgccctgttaggatacttcatccgctcctggaggaccctagccattctggttaacctgcagggaacggtggtctttctcttatctttggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtaattatactaaggcgtgttctgttgctctttaactaaggttgctcgagcttctcttgatatcctgctccttcttcagggtacagggaattttacctcttttgttagcttgaggttgttttctcaacagcaagtctcctgatccttagcgcctggttttctgcttgcgcagccccgtctttctcaagtagcagatgatagtgcctgatgggcaggtccactgagcttgagtaagtagacatcagaagcacatctttgcttttgaggtatttatcataaatatttaagccttcctgccccttcccctgc

SEQ ID NO: 28748 - DNA, 4720 bp, Homo sapiens
gccgccagcgcttccatccccgccccggcgggtccaagccggtgccgggcgcccaggggttgccgcgctgggcgggagggcagcgcctgagagggcggtggggtggcggggttcctgcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctgttctttgcagttggcattgcccaatatgccctgttaggatacttcatccgctcctggaggaccctagccattctggttaacctgcagggaacggtggtctttctcttatctttattcattcctgaatcacctcgttggttatactcccagggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtttgtgtgcagcttggtgtattatggcctaactctgagtgcgggtgatctaggtggaagtatttatgccaacctggccctgtctggcctcatagagattccatcttaccctctctgtatctacttgattaaccaaaaatggtttggtcggaagcgaacattatcagcatttctgtgcctaggaggactggcttgtcttattgtaatgtttcttccagaaaagaaagacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtgtccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatataccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattataagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcctctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttcattgacaggtaatgtattttggttgtgcggatggtttgtaaaaagtatcctgtttttttaattctattcaaaattaaaaattttttttcctaaaataaagcaagaaaaataaatgtaagatatataagaaaccccagagtttccagggtgaaagttcacattagcagcttgtccaaaatatttacacctcacaaatattttgaaagaaaccatgttgaaattttctgattttgtgagttacaaccacagcccagtaaaaccaatacttgttatttggctactttcaagcaatgcagatattctttagtatttaaaaatgagcaaataaacaaaatgaggcaaataaatgaagaaaatgagtttctgagacactgtttaggtaaccataaatcagacagatatttttatggtgggcaaattgatgaagatacttttagtaggtgatttatattcataacaaatacatattgaaataattgtcactactgtatcagaattaaaaaccagcttcacattaggacttctccatacaaatgctttatcattggttcttaaattggaaaaatatctataaatgattacatttttaagctaaataaaatgcagatattttggcttcttgtgaatgtaataaagaatcataaaacata

SEQ ID NO: 28749 - DNA, 2284 bp, Homo sapiens
cctgactgccttcctagccctccctcccacctgccccctgcccttgctctgcggtttcctccgcttcacccttctcctgccaccccctgccccccaacagcaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagagatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagca

SEQ ID NO: 28750 - DNA, 2409 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcatatcatagcctg

SEQ ID NO: 28751 - DNA, 2398 bp, Homo sapiens
cgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagagatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttgg

SEQ ID NO: 28752 - DNA, 1574 bp, Homo sapiens
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctacccaccccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacaca

SEQ ID NO: 28753 - DNA, 2883 bp, Homo sapiens
aaacagcccccaccctggaagcctcaggtgccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcacccc

SEQ ID NO: 28754 - DNA, 5658 bp, Homo sapiens
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctcgggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcacgcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcacactcagacaccaccgcttcctagagccaaatgagcaatcccaaactgcaagtgccataagtgggcctgtgaggtcacaccgcccggcccgaggtatcgcatgtgcgggggaggtccacactacagctgtcctctcgtctagaaggcaccacctcgctttcatgtcccgtgtgttttggaaaagcagtatggtgtgtcatgtctagcggcgaacacttccctccctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacaga

SEQ ID NO: 28755 - DNA, 2043 bp, Homo sapiens
gccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccaggcttcttcaaagtctcacagccagcctaccctcaaagcctgagtgattgtggaaggagccagcgttcactcagcagaggaacagagctttcctgccgcaggctctcagtgaagatccagggagcagaggcgtgggcaaggagcactgggctcagatgcaggagaaccggtttgaaccctagcactaccgcctctacactgaggaaccttggggattactcagccccctggaacctaatttccaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaa

SEQ ID NO: 28756 - DNA, 1663 bp, Homo sapiens
gcaattcactttggattttctaatatcccatttctaagaagaatggcagactattgaacaggtgtattttaggtcacgtggggactgcatccacctgaaaatccaccgttgacttatcaggaaactcagagatcaggatctttcacagagtagtcttttaagaagattcagttgtcaacagctagcagtctctttgccaaataattatatctgtgacttctgaaactatttggctgcctaaagttaaaggacttggggaaagtccttccactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcaatgggctttgatgtgctcctggatcaagtgggtggcatggggagattccagatttgtctgatagctttcttttgcatcaccaacatcctactgttccctaatattgtgttggagaacttcactgcattcacccctagtcatcgctgctgggtccccctcctggacaatgacactgtgtctgacaatgataccgggaccctcagcaaggatgacctcctgagaatctccatcccactggactcaaacctgaggccacagaagtgtcagcgctttatccatccccagtggcagctccttcacctgaacgggaccttccccaacacaaatgagccagacacggagccctgtgtggatggctgggtgtacgacagaagctctttcctctccaccatcgtgactgagtgggacctggtatgtgaatctcagtcactaaaatcaatggttcaatccctatttatggctgggtcacttctgggaggtctaatatatggccatctttcagacagggttggacggaagatcatatgcaaattgtgtttcctccagctggccatctctaacacctgtgcggccttcgctcccaccttccttgtttactgcatactgcgcttcttggcagggttctccaccatgactattttgggaaacacttttattctcagcttagagtggacattgccccggtcacgatctatgacaataatggtgctattatgttcctacagtgttgggcagatgctcctaggagggctggcttttgccattcaggactggcacatattgcaactgactgtgtctacacccataattgtcctcttcttgtcctcttggtatgaacaatctccacattctttgcctgtaagcgaggctatggtagacatagaaaggaaaattctgacacctgggatctgttcggtctctggcctagtcctgagccatgatgtccatagtacctattgtgtcacctgagaagcaaacaatggaataggatgacactatatgtggggaggctggcactttgcattcattattttagacatggaattatcatgaaattatttttcttaatagaaaaaatacccacttatttttgaagcaaatgtattatttatctaacttttggaatattatgtgatggagataatttgggggcttttgtcattgtaactgagattgaatataaggaaaacacaataaatttatctacataactatttaaaa

SEQ ID NO: 28757 - DNA, 1323 bp, Homo sapiens
aaacaatgcctgatatgtggagtaaagtcctcctccttggcctttgtcaagtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttg

SEQ ID NO: 28758 - DNA, 2299 bp, Homo sapiens
gtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttctcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaataa

SEQ ID NO: 28759 - DNA, 2303 bp, Homo sapiens
ctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtgggtttgcatgtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttctcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaataa

SEQ ID NO: 28760 - DNA, 2204 bp, Homo sapiens
aaacaatgcctgatatgtggagtaaagtcctcctccttggcctttgtcaagtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtgggtttgcatgtaagcatagaagaggccgggggctatatgggagtgagggtggccgctgagtttggggatttgaggaggtggtccaggagctttgttcctgctagcagcagccaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgccttgcgcccagcagagtgcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttctcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttg

SEQ ID NO: 28761 - DNA, 6944 bp, Homo sapiens
ggcggctgtcgcggggaccggaggcggaggctgcagcgggcactgcggcgccgaggcgcggcggcaggacgggaaccacgcgagctgcagccagctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagt

SEQ ID NO: 28762 - DNA, 6962 bp, Homo sapiens
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagt

SEQ ID NO: 28763 - DNA, 911 bp, Homo sapiens
ggggtacgaccagtgggccaccagccagctcattgggaccattttcttctgtgtgggaatcactactttgctacagacaacgtttggatgcaggacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatc

SEQ ID NO: 28764 - DNA, 2375 bp, Homo sapiens
attttgcaggcggctgtcgcggggaccggaggcggaggctgcagcgggcactgcggcgccgaggcgcggcggcaggacgggaaccacgcgagctgcagccagctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctct

SEQ ID NO: 28765 - DNA, 5768 bp, Homo sapiens
cccttcacacccgaccctgccttgaattaggattccataggagagctgggggcaggagaatggggtgttccctgctgtccagcttcagacccactctttgagatattggattctgacaagtttccagagctgagaagacagccagatgtcaaggtctgaagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagccgggcgatggggccattgcggtggatgagctacaggataacaagaagctgaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtattttctttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctga

SEQ ID NO: 28766 - DNA, 5714 bp, Homo sapiens
cccttcacacccgaccctgccttgaattaggattccataggagagctgggggcaggagaatggggtgttccctgctgtccagcttcagacccactctttgagatattggattctgacaagtttccagagctgagaagacagccagatgtcaaggtctgaagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtattttctttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctga

SEQ ID NO: 28767 - DNA, 3323 bp, Homo sapiens
tgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagccgggcgatggggccattgcggtggatgagctacaggataacaagaagctgaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatgga

SEQ ID NO: 28768 - DNA, 3246 bp, Homo sapiens
atggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctga

SEQ ID NO: 28769 - DNA, 2170 bp, Homo sapiens
tgaaagaaccatctggttgagtctaaagttggaagatcaccatatccaccagaagacccaggatggatctgcaacaaagcaccaccatcacttccctagagaaatggtgtttggatgagtcactgtctggctgcagaagacattatagtgtcaagaaaaaactgaagttaattcgagtcttaggccttttcatgggtctggtagccattagcactgtctcattttcaatcagtgccttttctgagacagatacacagagcacaggagaggccagtgttgtaagtggccctagggtagcacagggttaccatcagagaactctcttagatttaaatgacaagattctggattatactccacagccacctctttctaaggaaggcgagtctgagaatagtacagatcacgcccaaggagactacccgaaagacatcttttcccttgaggagagaagaaaaggtgcgatcattctgcatgtcattggaatgatctacatgttcatagccttagccattgtctgtgatgagttctttgttccttctttgactgtcatcactgaaaaactgggcatctctgatgatgtggctggagccaccttcatggctgcaggagggtcagccccagaacttttcacatctctcataggggtatttatcgctcacagcaacgttggcataggcacaattgtaggttcagcagtattcaacatcctctttgttattggcatgtgtgctctgttttctagagaaatcttaaacctgacatggtggccgctctttcgagatgtgtctttctacattgttgacttgatcatgctgatcatatttttcctggataatgtcatcatgtggtgggaaagcttgcttctcttaacagcttatttttgctatgtggttttcatgaaattcaacgtccaagtagaaaaatgggtgaagcaaatgataaaccgcaataaggtcgtcaaggtgacagcaccagaagcccaagcaaagccatctgcagccagggacaaggatgaaccaactctaccggctaagccgcgtctccagcgaggtggaagctctgcctccctccacaacagtctcatgaggaatagcatcttccaactcatgatacacacccttgacccactcgccgaagggaggttcagagaaaaggcttcaattctccacaagatcgccaagaagaaatgtcatgtggatgagaacgagaggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacagg

SEQ ID NO: 28770 - DNA, 2221 bp, Homo sapiens
tgaaagaaccatctggttgagtctaaagttggaagatcaccatatccaccagaagacccaggatggatctgcaacaaagcaccaccatcacttccctagagaaatggtgtttggatgagtcactgtctggctgcagaagacattatagtgtcaagaaaaaactgaagttaattcgagtcttaggccttttcatgggtctggtagccattagcactgtctcattttcaatcagtgccttttctgagacagatacacagagcacaggagaggccagtgttgtaagtggccctagggtagcacagggttaccatcagagaactctcttagatttaaatgacaagattctggattatactccacagccacctctttctaaggaaggcgagtctgagaatagtacagatcacgcccaaggagactacccgaaagacatcttttcccttgaggagagaagaaaaggtgcgatcattctgcatgtcattggaatgatctacatgttcatagccttagccattgtctgtgatgagttctttgttccttctttgactgtcatcactgaaaaactgggcatctctgatgatgtggctggagccaccttcatggctgcaggagggtcagccccagaacttttcacatctctcataggggtatttatcgctcacagcaacgttggcataggcacaattgtaggttcagcagtattcaacatcctctttgttattggcatgtgtgctctgttttctagagaaatcttaaacctgacatggtggccgctctttcgagatgtgtctttctacattgttgacttgatcatgctgatcatatttttcctggataatgtcatcatgtggtgggaaagcttgcttctcttaacagcttatttttgctatgtggttttcatgaaattcaacgtccaagtagaaaaatgggtgaagcaaatgataaaccgcaataaggtcgtcaaggtgacagcaccagaagcccaagcaaagccatctgcagccagggacaaggatgaaccaactctaccggctaagccgcgtctccagcgaggtggaagctctgcctccctccacaacagtctcatgaggaatagcatcttccaactcatgatacacacccttgacccactcgccgaagaacttggatcatatggaaaactaaaatattatgacacaatgactgaagaagggaggttcagagaaaaggcttcaattctccacaagatcgccaagaagaaatgtcatgtggatgagaacgagaggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacagg

SEQ ID NO: 28771 - DNA, 3893 bp, Homo sapiens
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatcct

SEQ ID NO: 28772 - DNA, 2975 bp, Homo sapiens
cagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgt

SEQ ID NO: 28773 - DNA, 2807 bp, Homo sapiens
cagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgt

SEQ ID NO: 28774 - DNA, 1656 bp, Homo sapiens
ccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtga

SEQ ID NO: 28775 - DNA, 996 bp, Homo sapiens
agcaggcggggcacccggactggcggcttcgctggcgcaaggtcggtccggcggccagggacctggaaggctgcgaggccctgcgaggtcgaggttcggagtttgctggtcccaggcccggcccgaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctacca

SEQ ID NO: 28776 - DNA, 925 bp, Homo sapiens
agagtaggggcccggacgctgcagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgg

SEQ ID NO: 28777 - DNA, 555 bp, Homo sapiens
aagacaagggaggagcagagccctagcaggatactaaatgggtctatgtgactttagggaccctctgcttttggactagcctggaacccaggttcagtcctgctgacctggcactggaagggaggcagggtgctggcacccacgagcaagccacagccaagcaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctac

SEQ ID NO: 28778 - DNA, 3289 bp, Homo sapiens
cgaggttcggagtttgctggtcccaggcccggcccgagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgtagagaaaa

SEQ ID NO: 28779 - DNA, 1879 bp, Homo sapiens
atcgaagcggggccgaggccggaagcagccccgggcggaagccctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtt

SEQ ID NO: 28780 - DNA, 1383 bp, Homo sapiens
aaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggggaggttatgcctgactatgggagatctgaaggacaatatgagggattttggatgtaaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccac

SEQ ID NO: 28781 - DNA, 2131 bp, Homo sapiens
gagactcctgcaggttcgagaaagcatgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggct

SEQ ID NO: 28782 - DNA, 2057 bp, Homo sapiens
aggttcgagaaagcatgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcagggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggct

SEQ ID NO: 28783 - DNA, 2429 bp, Homo sapiens
gagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatggaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtattt

SEQ ID NO: 28784 - DNA, 2979 bp, Homo sapiens
gctcgctcactcgctcgtccccggcttccgagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgta

SEQ ID NO: 28785 - DNA, 1616 bp, Homo sapiens
ctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcac

SEQ ID NO: 28786 - DNA, 1062 bp, Homo sapiens
atgggtatctttcccggaataatcctaatttttctaagggtgaagtttgcaacggcggccgtgattcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggtgcttatgttcaaaagctgttaccggctgtgtgctgtggctcatgcctgtaatcccagcactttgggaggccaacgcgggtggatcacttgagggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaa

SEQ ID NO: 28787 - DNA, 969 bp, Homo sapiens
atgggtatctttcccggaataatcctaatttttctaagggtgaagtttgcaacggcggccgtgattcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaa

SEQ ID NO: 28788 - DNA, 831 bp, Homo sapiens
cgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggg

SEQ ID NO: 28789 - DNA, 1621 bp, Homo sapiens
gtccgatgagcccgagcagcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcctaaattcccttgtctctcctattatcagaacttcaagccttatgaacactttatacttcacagaaatgccaggtgctatgggggcttgggtacttgggaacattgtctaatacagcagcctatcagaggtctatttgatttacatttatccatacatagcttctatatctaataagcacatctattatttgctttggttaattttgtttgagaaagcaaacttttctcagtgggaatcagaaaaaaaggggtaaataaggtctgtgaaactaaagcacagttttttggctaaagactgttactgatctcattttacattttctttgtcttgcaacctttatgataattttgttactcaaatgcatttggcatgtgatgctgtggtttgaaaaatttatgtaactaatacatggtgcatgatactttctacttaggaatcttgttaggtttagaaactctcctttaaaaaaaaggctgagtttcagattgaaaattgaagggacagcctttgaatgatgtctctttagaaaaatttcctgtctctttagattgtaacgaaaggccaagtgccaggttttatctgatgggtctgagttatattgtacagtttacgtttggcctaatttctgtttaagtgggcagggagtgaaagtggggtcgatctacttaaacttttcctcttagttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctata

SEQ ID NO: 28790 - DNA, 1019 bp, Homo sapiens
agtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcct

SEQ ID NO: 28791 - DNA, 2894 bp, Homo sapiens
ggaagcctctgcttgcccaaagtgaaagagaaagtgcccccccacccaagcccgccccaccccgccccacggccaatccctgcggcccctcgcctcctcccccggcagcttccccttctgtgtgagtgctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtaga

SEQ ID NO: 28792 - DNA, 591 bp, Homo sapiens
gtgcacgtgagccccgagcgtgagcggcgtgtgaggctggctgggaagacgctggcggtggggagggggggactgaaaggaagccaggtggtcccaggggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcggg

SEQ ID NO: 28793 - DNA, 620 bp, Homo sapiens
gtgagcggcgtgtgaggctggctgggaagacgctggcggtggggagggggggactgaaaggaagccaggtggtcccagggaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctga

SEQ ID NO: 28794 - DNA, 594 bp, Homo sapiens
agcatgggactgggtggcaggtgcctcccgctgctgcaccctcaggacgcagtgacggcttcagtctggggtggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcg

SEQ ID NO: 28795 - DNA, 579 bp, Homo sapiens
ccccttctgtgtgagtgctgggctggagtgtggaagagccatccagagacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgccc

SEQ ID NO: 28796 - DNA, 552 bp, Homo sapiens
aaaagccggagctggctggggtgcacgtgagccccgagcgtgagcggcgtgacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggct

SEQ ID NO: 28797 - DNA, 558 bp, Homo sapiens
atgggaggagagctatacctgggatagctgagcccaggtcggggggtcttagggcgcccgggaccccagcccctagctcgaagggggcaggtgccggctgctgctctctctgtgctgaaggatgtgggggatggtcaccacagctgtccaggtcgaggtgctccgaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccg

SEQ ID NO: 28798 - DNA, 535 bp, Homo sapiens
gtgagtgctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccgaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccga

SEQ ID NO: 28799 - DNA, 1790 bp, Homo sapiens
acatacgtgtccccgagggtgggtgtccggggcccgagcccaaggaagaaaggccgacccgtgtgggacgcacacgtgggagttcaccggacatctgtggacacgtgcgtggccggagtcgcggtggccaggcggaggacggagcggtcggctgagccccagcagtagggcaggggcctgagccggcctccgagcgcagagagcggcccccaacccgcttctcctttgtcctctggccgaggcatcgcgcagttggagtccccttccgggaccctccagccagcaggatagaaagcaccgccccaagaggacggggacagcgggagattgaatggggagccgccggccagactcggagcctcacccccattgcctttcttgggggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggc

SEQ ID NO: 28800 - DNA, 605 bp, Homo sapiens
gagggcggagcgcgcgcggcgccgagcggacgcgcctccccgcctaggtgctggccgagcgcggggcgggcaggcgagcgcggcggcggcggcgagcgtggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggc

SEQ ID NO: 28801 - DNA, 589 bp, Homo sapiens
agctctgcaggccctaggtggagctgccatgggaggagagctatacctgggatagctgagcccaggtcggggggtcttagggcgcccgggaccccagcccctagctcgaagggggcaggtgccggctgctgctctctctgtgctgaaggatgtgggggatggtcaccacagctgtccaggtcgaggtgctccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccc

SEQ ID NO: 28802 - DNA, 585 bp, Homo sapiens
catacgtgtccccgagggtgggtgtccggggcccgagcccaaggaagaaaggccgacccgtgtgggacgcacacgtgggagttcaccggacatctgtggacacgacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagaga

SEQ ID NO: 28803 - DNA, 684 bp, Homo sapiens
agtgacggcttcagtctggggtggtgggtgaggggctgcgtgagagagggaggctgggggaggattactcttcgggtggccccaccctcactcattcccattccctcatccttctaggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagg

SEQ ID NO: 28804 - DNA, 1835 bp, Homo sapiens
gcagcttttccgcacgcgcctcgccggcgcgcggctctctcagcgtcccaagagccactttctcgccagtacgatgctgcagcggttttccggttttccgcttcccttcatcgtagctcccgtactcatttttagccactgctgccggtttttatatccttctccatcatgcatcgtgagcctgcgaaaaagaaggcagaaaagcggctgtttgacgcctcatccttcgggaaggaccttctggccggcggagtcgcggcagctgtgtccaagacagcggtggcgcccatcgagcgggtgaagctgctgctgcaggtgcaggcgtcgtcgaagcagatcagccccgaggcgcggtacaaaggcatggtggactgcctggtgcggattcctcgcgagcagggtttcttcagtttttggcgtggcaatttggcaaatgttattcggtattttccaacacaagctctaaactttgcttttaaggacaaatacaagcagctattcatgtctggagttaataaagaaaaacagttctggaggtggtttttggcaaacctggcttctggtggagctgctggggcaacatccttatgtgtagtatatcctctagattttgcccgaacccgattaggtgtcgatattggaaaaggtcctgaggagcgacaattcaagggtttaggtgactgtattatgaaaatagcaaaatcagatggaattgctggtttataccaagggtttggtgtttcagtacagggcatcattgtgtaccgagcctcttattttggagcttatgacacagttaagggtttattaccaaagccaaagaaaactccatttcttgtctcctttttcattgctcaagttgtgactacatgctctggaatactttcttatccctttgacacagttagaagacgtatgatgatgcagagtggtgaggctaaacggcaatataaaggaaccttagactgctttgtgaagatataccaacatgaaggaatcagttccttttttcgtggcgccttctccaatgttcttcgcggtacagggggtgctttggtgttggtattatatgataaaattaaagaattctttcatattgatattggtggtaggtaatcgggagagtaaattaagaaatacatggatttaacttgttaaacatacaaattacatagctgccatttgcatacattttgatagtgttattgtctgtattttgttaaagtgctagttctgcaataaagcatacattttttcaagaatttaaatactaaaaatcagataaatgtggattttcctcccacttagactcaaacacattttagtgtgatatttcatttattataggtagtatattttaatttgttagtttaaaattctttttatgattaaaaattaatcatataatcctagattaatgctgaaatctaggaaatgaaagtagcgtcttttaaattgctattcatttaatatacctgttttcccatcttttgaagtcatatggtatgacatatttcttaaaagcttatcaatagatgtcatcatatgtgtaggcagaaataagctttgttctatatctcttctaagacagttgttattactgtgtataatatttacagtatcagcctttgattatagatgtgatcatttaaaatttgataatgactttagtgacattataaaactgaaactggaaaataaaatggcttatctgctgatgtttatctttaaaataaataaaatcttgctagtgtgaatatatcttagaacaaaaggtatcctcttgaaaattagtttgtatattttgttgacaataaaggaagcttaactgttat

SEQ ID NO: 28805 - DNA, 1338 bp, Homo sapiens
aagggggagctgcgggccaggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttcta

SEQ ID NO: 28806 - DNA, 1274 bp, Homo sapiens
agctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 28807 - DNA, 2062 bp, Homo sapiens
gcagcgggactgagccgcgcccacgtggaagccgccgcaggcttcgcgcggggccccccgggtgcacgcgggcaggggccggggtctcccgacgcacgaccccggagagtgttgaaagggtcggagctgcccggaggtcaagggtcaagggtcgggggtcggggcaccacatgtcgcacatcccggcggggtcgccgcggcctccgggagaaagcggacgacgcactcggagcgaactgggcatcagggtgggcttctgactccgcagctgccctcccgcccgctcgggtactggcagcggcctgaccttcacaaggtcaaggctgccgcggaacccccagcggcccctacggcgcatgggcggggcctggctcccggcatacctaggggtgcggggcgggacgtctccggggagcgcagccaatgggcgcggttcgctggagtgcggggcgggacgcagcgggattcccggcagccctcagaggcgaggcacgcaggctggtgtggggcggggcctggcggcgcagccaatgagcgcggcgcgaggaggcgcgggggcggagagtgggcgtggcgtcggcgtcttagcggctgcgcggtggctgctccgtcctttcggtccaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtc

SEQ ID NO: 28808 - DNA, 712 bp, Homo sapiens
cacggatcggcagcgggactgagccgcgcccacgtggaagccgccgcaggcttcgcgcggggccccccgggtgcacgcgggcaggggccggggtctcccgacgcacgaccccggagagtgttgaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggaga

SEQ ID NO: 28809 - DNA, 1641 bp, Homo sapiens
ggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgc

SEQ ID NO: 28810 - DNA, 1514 bp, Homo sapiens
gctgaggccccgccccacttccgggttgggccgtgggctggggagtcgtggaggcgcggtcctggtccccacccggcgcgctgggactcgcccgcctcccgtctgtcaccccctgcgcctcgccgggacaacggggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccg

SEQ ID NO: 28811 - DNA, 1766 bp, Homo sapiens
gcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaggtagccatgtagagacacaaaaataaatgaagaagctggacatggtgggatgggcatgtggtcccagctactctggaagctgaggtgagaggatcacttgagccctg

SEQ ID NO: 28812 - DNA, 1644 bp, Homo sapiens
gtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggagaagaagaggagtttacttcaaacagaacctggcaatcggataaataccttcaagtgtctgtctccgtaaaaatgttccagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattg

SEQ ID NO: 28813 - DNA, 1586 bp, Homo sapiens
gggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaaccca

SEQ ID NO: 28814 - DNA, 1166 bp, Homo sapiens
gggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctc

SEQ ID NO: 28815 - DNA, 468 bp, Homo sapiens
ggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtacagtgtggtctgtcatcaaaagtattcttaggaaagatggccccttggggttctaccatggactctcaagcactttacttcga

SEQ ID NO: 28816 - DNA, 2738 bp, Homo sapiens
ggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggtggcacgtgcctgtaatcccagctactcaggaggctgaggcaggagaatcgcttgaacccgggaggcagaggttgcagtgaactgagattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaata

SEQ ID NO: 28817 - DNA, 1562 bp, Homo sapiens
gttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacagagtctcactctgtcacccagactggagtgcagtggcacgatctcggctcactgcaacctccgcctcctgggttcaagcgattctctcacctcagcctcctgagtagctgggattacaggtacgcgccaccatgtccagctaattttttttggtattttttgtagagac

SEQ ID NO: 28818 - DNA, 1417 bp, Homo sapiens
cggagcgtagggttgagcggcttcccccgcactggggtgagagcccagaacaggcggtagagccaccccaccacccccaactccattccccgcgctcgctgcggctggacgtgaaaagccggtctcacgctctggggagttagtcgccttccactgggaccctcagacgagtgagcgaacatgaagtccggtcctggcatccaagccgccatcgacctcacagcgggggccgcaggggggacagcgtgtgtactgactgggcagcccttcgacacaataaaagtgaagatgcagacgttccctgacctgtacaagggcctcaccgactgcttcctgaagacatacgcccaagtgggtctccggggcttctacaagggcaccggcccggcacttatggcctacgtcgccgaaaactcggtcctcttcatgtgctacgggttctgccagcagtttgtcaggaaagtggctggaatggacaagcaggcaaagctgagtgatctccagactgcagccgcggggtccttcgcctctgcatttgctgcactggctctctgccccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttgtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagagtacaagaccactgtctaattttgacttcatgggaattttggttttatcttcccttcttctaccctaaatcttaactttatggaagggcctctattttacatcatataatttctgcccataattgtattgaaataggaaagttgctgctcttgcacttgctggaatgtacagggtgggctggttggccctatgtacctaatctgaaaaactaaatatcgttctgtcagggcctttgcataaagccatttgtgtgtacatgca

SEQ ID NO: 28819 - DNA, 1814 bp, Homo sapiens
aacagcgcctttcctctggtttccaaatcagttacgccccttctcgcacgcttccatcaagctcctccttcagctccgccttactcccggccgcctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagccccaaatctggagagtctggggggtggctaggagaggggaggagactggacaaagaagctggagaataggaactggagtttttaagaaaaattgttaaagaaaaagcagccgctggttttttgcaaatgctgtataaatctgtcatgccacagcagctgacagggccagaaaaactcaaa

SEQ ID NO: 28820 - DNA, 1647 bp, Homo sapiens
acagcgcctttcctctggtttccaaatcagttacgccccttctcgcacgcttccatcaagctcctccttcagctccgccttactcccggccgcctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagccccaaatctggagagtctggggggtggctaggagaggggaggagactggacaaagaagctggagaataggaactggagtttttaagaaaaattgttaaagaaaaagcagccgctggttttttgcaaatgctgtataaatctgtcatgccacagcagctgacagggcc

SEQ ID NO: 28821 - DNA, 2405 bp, Homo sapiens
gtttatccttggttagactgtatttcctatatataatattttgagataccttaaatcaaaactttatttcttcaattatctttaaatggattttagtaaaagacttctcttccttaggattttttctcttggttcttcagatcttgactagagccagacagttggatgtgtgcttttttactgagtttgttcattgcttcatttgttccactatttatttaacaaatgtttataaagtatataccatgtgtcaggcacattgttacaattctatctggtatttttttttaatcatttcaggactggtgaggaatattttaatatctcaagatggtgttaaattgggatcatatgttttcaaaaaagaagcacctggctcattgtattgttctactctgaggcaaccttggggggccaagatccccatccttaagcttgtaaggatcatgatgcttgtgaagctgtttcaggtgttttgtgacacttacctgatgcttgctgcctgcctatcctaatgctctcagcaaggaggaactcttcagcgagcttctagtctctgttaaggcacttttaaatgtcaccacctttccccctcctgtcactcattgtaccatatccatactcacttcaaaccgtgtgagctacttaagtaagagttgtaaattgtgtgttttatctgatattgtcatggacttagcatgttagctgtaagccactctcatctctaaagctgttacgttaaaattatatttaaagctatatcaaaattgctactttgaatggtatataaattgacaaatagattgcctgttgtacaaatgagggaacttattgctcttcatctggagagctgctgccgccagccattttgctatcagcaaagcttccaaatcgcttctaacagtagtggcttgtgttgtaccctggcacaaagagacaccttaccttaggtctcctaagaggtcagtgacagagatataaatggaatattggtatgtagctttaaagcagcaaagcttaaaagctgacattttgccttccctttttctctccatctttcttgttaaaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcac

SEQ ID NO: 28822 - DNA, 565 bp, Homo sapiens
aggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgttgtgactcccggccaggcacagtggctcacacctgtaatcccggcactttgggaggcctgaggcgggtggatcatgaggtcaggagatcgagaccatcctggctaacatgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggttt

SEQ ID NO: 28823 - DNA, 2262 bp, Homo sapiens
ctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatc

SEQ ID NO: 28824 - DNA, 777 bp, Homo sapiens
gtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcagggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctc

SEQ ID NO: 28825 - DNA, 1505 bp, Homo sapiens
aactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggatttgttcaagttgaaattgtaaacctatgccagaacttgcatgaagagatgattgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacatta

SEQ ID NO: 28826 - DNA, 1909 bp, Homo sapiens
gtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 28827 - DNA, 1678 bp, Homo sapiens
gtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 28828 - DNA, 1415 bp, Homo sapiens
accaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatg

SEQ ID NO: 28829 - DNA, 1285 bp, Homo sapiens
cgcaacctttccaagggagtggttgtgtgatcgccatcttagggagtgaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttca

SEQ ID NO: 28830 - DNA, 1359 bp, Homo sapiens
aagggcacacatcttaggacccggaggacgtccggcctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatg

SEQ ID NO: 28831 - DNA, 1351 bp, Homo sapiens
atcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 28832 - DNA, 1023 bp, Homo sapiens
atcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactgactgggaactccagatgtcaatggaagttttacaagatcaaaggaagactatgg

SEQ ID NO: 28833 - DNA, 2785 bp, Homo sapiens
ttataggacaactaactgaggaatttattcacttgtcccttcttttgaacctcactgtgctctggcttgccaggaggtgcaagtgtcgtccccgctttgtacttggcgctccaggcctgggtcacttcacttgagttatcagaggcaaccgtctagtttgacaaactaccggaggctcctgatagagaagggcgtgggcgccaatctaggagacaaagcctgagccgctgcggtgagccaacccaaacccatccgcgggtcttctttccagagacattttcggagccgagggcgcctctgcgagagcgctgcgaacaggttccgacgcgccggagatcgcgcgacgaatctgcgcctcgaaccctcgctttccagcagtcgccggattgctgctccacagggagccaacgcgcttgaggaccagcccagccggggctctctggatcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtgattgcctatgaagtgtttttcccccttgagataatggatatttgctatgcagcaccatgaagaagagagactatcgatcggccaggtgtataattatgaaggagaaaactgttcaagaacaaaatctattttaatactttaaaaaatgtctataggcaacttgagattatagttttggctgtataaataaaactgtgagaagaaaaaaataatatgaaacaatgaggtatttaaagtgaatatagaaaaatagcatagaaatcatatatttatttcataaaataaatagaaactttgtctcctgtgttcctcttcaatgcttcacaatgaaaattcattgtattgatcagcatttttcctaagaggtctagaaatgcttaaactattgaaaataaatcaaattattcaaagactggattaaaaaaaagttaagccaaaatttaagcagtttttataatgaattaaattattccataaataatatttaaagagcacaagaaaaattttttaaagtgcactaaaatgaccttttaagaatgtttaattttatgaatactatgttaaaatgtaaatctgttggttttttttagtaactatgcacatatcagctctattttcctacatctactttatatctcatattgctgtaagataataaataggtattttaaaacattgtttaaaacagaatgttaaaacactgttgtttaagcatgtttaaatcaaggtattccaaatctcttctaacacaagtaggaaacatgaaataaaatttactttcctccacatagttctctttgaagataagttttgttgatgagatattgtcatgttaaatcacaaattggaaacacctttggacccatttgtcagccatcagtatttgcatccaaatacctttattcagcatgcctacctgtgccatttttaggaagaatgtatagaacagaactgcattttcaggttattagttttaaacgacaacttcaggtgggaagtcagctgtctgcagtattaaaatatgtatgatgaaggggaaatgttctgaaaaagaaatacacttagcatttctaaggattactatactaacatgtatcaacaaaaatatctccttggtcttgatgtaaccaaacttgattttatatctgcatccagagatgatgctgattcagtaaagtcaacaagaataactgaaagtccatatgacacctgtcctaagttactaccgtgggctatttctactacggggctatttcactaaagcattttgaaaataaaaagtaaaagataacatggtaattattactttttattaatttagagcatttgaagtataaaaataaaaggcttttgacatactgtatatacat

SEQ ID NO: 28834 - DNA, 1554 bp, Homo sapiens
tgcgcgaggagctagagagagcggagagcgctgagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgttt

SEQ ID NO: 28835 - DNA, 1651 bp, Homo sapiens
agtagagttttgctgttaagactgcgcgaggagctagagagagcggagagcgctgagccgggccgcacccgccgagccgtcccttctccctgtgatcagttaccaactacctgttgatgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacac

SEQ ID NO: 28836 - DNA, 792 bp, Homo sapiens
atggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaagtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctga

SEQ ID NO: 28837 - DNA, 2331 bp, Homo sapiens
cacttgagtgggctcactcagtgagcaggagtttgctataaagttgccagatgtcttggaaaaccagttgatctctgggaccaacaattgcctatcaagcctgttcattcgattctcaaatattattaagcacttaccatgatgggctctattccaggaaccggaaatttacgagtgaacaaatgagaccaaggtcgtgtttccacgggcttacattctagtcagggagagagacaagaaacaaatgtactgtataaataacccatggcgtgccgggcgctgtggctcatgcatgtaatctcagcaattcaggaggctgaggcaggagaatcacttgaggccaggagttcgagaccagccagggcaacattgagaccttatctctacaaaaataaaaaacttagccaggcctgcacctgttaagtgacagctaattgggaggctgaggcaagagaatcacttgagcccaggagttcaaggctatggtgagttatgatggcaccactgcattccagcctgggcaacagagtgagaccctgtctctaaaaaagtaaacaaatatgccatagtaataagtactgtaaagaggaataaaacaagtgctattttattttatttttaaatttttgtattttttgtagagttggggttttgcagtgttgcccaggctggtcttgaactcctgagctcaagcaatccacccacctcggcctccgaaagtgctgggatacaggcatgaaccgctgcgcccagtccaaaagtgagtgctattttagacagtctagtcagggagggctgctctgaggaggtgatatttgagcagagaccataagaaacttgcctggtgtttattccgtatctcttgcatttagcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacac

SEQ ID NO: 28838 - DNA, 1657 bp, Homo sapiens
agtttcgtccgagctcagtagagttttgctgttaagactgcgcgaggagctagagagagcggagagcgctgagccgggccgcacccgccgagccgtcccttctccctgtgatcagttaccaactacctgttgatgtgtgtggttacagacttctttctatgctttgtacaactctacagaccgtatcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatctt

SEQ ID NO: 28839 - DNA, 1567 bp, Homo sapiens
agtttcgtccgagctcagtagagttttgctgttaagactgcgcgaggagctagagagagcggagagcgctgagccgggccgcacccgccgagccgtcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatctt

SEQ ID NO: 28840 - DNA, 3136 bp, Homo sapiens
ggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 28841 - DNA, 3192 bp, Homo sapiens
aatgggcgggcagcatccacatgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtg

SEQ ID NO: 28842 - DNA, 2258 bp, Homo sapiens
aaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcaga

SEQ ID NO: 28843 - DNA, 2139 bp, Homo sapiens
ttcagaatcacgccggcctcattctaccgctgctctctcctggatctcggccacggatcttttgctcgcgaaagttcctccgtctagctgcacacaacgctgctgcaggaaaccgaggtaagggatttgccgagacttagctccaccacactccccgaggccccgcccctcctctctggccctcccctaggcccaggtgtctcgcgttgcacgtgcagttgttgtggttctacgtcacgtggtcccggaagttcaagacagacccgcctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagt

SEQ ID NO: 28844 - DNA, 2673 bp, Homo sapiens
aacctgaagctctcagagcttccctgtcttcatctatcagcccagggagaggaatcagtggttttccaaaagctgtacctctttccataaatacaaggatgaagggctgagatgatggcagttagaattatattgagaaatggtagcgggatctgagaaagcaaggccatgagttgaaagcagagagaaggcggttcgagtggagccctgatgaagttcatgctcatggttgcccagccattaacacgggctcatcacatctgtttccagattgcttctagaacttagctaccctcgttctataagatggaatgaaaatgcgtactacatacagatcatgaaaagacgcaaagaaaatgcatcttcacattgcagttcagaatcacgccggcctcattctaccgctgctctctcctggatctcggccacggatcttttgctcgcgaaagttcctccgtctagctgcacacaacgctgctgcaggaaaccgaggtaagggatttgccgagacttagctccaccacactccccgaggccccgcccctcctctctggccctcccctaggcccaggtgtctcgcgttgcacgtgcagttgttgtggttctacgtcacgtggtcccggaagttcaagacagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagtaa

SEQ ID NO: 28845 - DNA, 3869 bp, Homo sapiens
ggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaaggttggaagccatataactgcttttgaatagagcagctaaagaagtcccaagttgccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttgagatgtgtccagcgccccctgtggtgtgtgagagaaagcagctgcaactcaagtgactaggtgggcccagctggcttcgtgcaggagggcacgatccaagtcctgtgagcgactgatactccacatgggagttacaactatgtacagatgagtgacgcttgaacccaagcttcctcgcagcctctcctacctctctttcccgtagagattggtatgacaagaactgaggtagacaaaacctagctttttggtgccaacagcagtggcaccctctgtttcccggggagctgtcctgtcagtggcgtggactcgggactggcgtcacatgctttggggaggtggccattggaaacaagcaagtactgggcttccgcgcgctctggactgcctgaagttaatgaagatgcaggctgtagctctgtggagtccgggtgatacaaccttgctaaagtccaggaagaatcccctacaaggaaagaacgaacctgtcagacccccacttgaccgtttaagcagctcccaacccacctgttagaagacagtcaaaagttacctttcccatctagagatgccattggctttttcttcacagccgtcagcattctatcgtggttactggggtagagcgacccttggcactcggggcaggacccagcggcagtcctgctgcactggtgatgtggagaatgctcttggtcactcccacccggctccgggccatttggcgcacttggctgtgcgctgtctctggacacaggctgggggtggaaggcttgtcccctggagtaacagtccacttcggtgttgcagtcactgcatacgacccggccaccgtgttctgaaggacagcgccaaagatgggttagagtcactgctgtgggagtcttcgtccccacacagaggacaggctgctcagctccactgtgcaaggcaaaggtcatgggggagctgctgctgctggctgctgagcatgtaaaccggatgtccttgcccaccatagccatggtggtttctggctgggtgatgatctgtggcttcaggaagtcatctggggagagaagggtcaactgtaaagcgctgggttcttggtacacagaggaaccagctgctgttcatgctaacagaaactgacacagacaccaagcaggaaccagagcttgaggtccctgtgcatcctcagccccaccaaccagatgccgtaagagttgcaccatggacatctgacctcatctaattagaagtctgtgagtactgatcacctttatgatcacactccttgattagaaattaacccaccacttctcagttctcaaaccagccagccggcagtttccttaagacaactggctctgcctgctgactttcacacaaaacagtcaggcaccactggtcatgactgcagagatcttacccacaaaccttactccaaaaggagggggtgtaaaacacttccaaaatgtcagaataaggacctccaaaaatctgcacctccattaaaacaaggaaaacacctggaaaaatggtcaaaagcaactttttcagaattctggaaaaccaaaggcttacaacaatccatggattgttgattcaagcaaatagcaacatctcagaaatgtgagctttgtggtattttaacttatccaaagccccattcttccctccccagctccatggtagccttgaaacccagcagcctagcaaccactcaagggtcagaatgggctccccaaaagccccatcctcagaactgacaccatgtggcctatctggcagcaacacggaaagccccattcacaggatttgcattgatttgccctgatctagtttgccgagcaggagaagccctagccccagggcacatgactacaacaatcagtagccactgttcaacagcgcagctgtctgaggggacaatacccatggggcaaacaagcagctggccaaaaaactataaaggaaaatgtggggaatacagtgttaatggtgggctttgaaaaggtccaatacattcctggggatctagacagccacatgcaggtgcaaggccatgtgcacacccaggaaagacgtgagggggtcctcatttgtcacctgtggctgagcatgactgtctacacaaataggaagtgatggcacaccccaacacaaacacacaagccgtcggtaaaggataggagacagtggttgtggtgacttctctgtccaaccattagctaaccactaaactaaacaagcagggacttaaggggacggactttatatagcctttgtccaggaaaagtcactaggcaagctgtaacaataaacagcaacagcagcaaatcctgggggaggagaaagggaatatccaatttccagagttgccacattattttattttaaatgcccaattttcaacaaaatattatgaaacactcaaacaggaaaaaaagcagtcaacagaaactgtctctgagggagcccagacttagattcactaaataaactttttaaatcggcaattataggcatattcaaacacctcaaggaaaccatgtcttaaaaaaaatatcgaaggatagtggccaggtggggtggctcacgcctataatcccagcactttgggaggctgaggcaggaggatcatgaggtcaggagatcaagaccatcctggctaacatggggaaaccctgtctctactaaaaatacaaaaaaaaaaaaaaaattagccgggtgtggtggcaggtgcctgtagtcccagctactagggaggccgaggcaggagaatggcatgaacccaggaggcggagcttgcagtgagccaagatcacgccactgccctccagcctgggtgacagagcaagactctgtctc

SEQ ID NO: 28846 - DNA, 1196 bp, Homo sapiens
actacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatggctgctgtgattgtcaacagcagcaggagccagttgaaggtttga

SEQ ID NO: 28847 - DNA, 2963 bp, Homo sapiens
gactacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttcctctgacagccacacaccgaatcttgatgaaaaaagagaagagcatttgccttgttacatagtctgttacaagccagatatgttgctagctctcaagagttgtaatatattaagaactacaacttatttgattaaaactcagctgtatagatccttttataaagcaccttttgttaaacatcagcctttcattggtattttaaaagcaaggcagatagatatgaagtcagccaactctgacatgcgtcctttcttatctcccttacctgacactaggggctctagagaggcagagagagcactcacaaatcacactaaaactgccagcggcctgactcttactcagtttagcaaaaattcttgcctaaaaagtgataagtaaaaatctgtttatggtatacagttatgtctcgaatctttgaatcaaatccatgttcttattttagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaacaa

SEQ ID NO: 28848 - DNA, 1322 bp, Homo sapiens
actacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttg

SEQ ID NO: 28849 - DNA, 650 bp, Homo sapiens
tgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttc

SEQ ID NO: 28850 - DNA, 659 bp, Homo sapiens
ctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtat

SEQ ID NO: 28851 - DNA, 526 bp, Homo sapiens
aatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatggctgctgtgattgtcaacagcagcaggagccagttgaaggtttgataaaagcagatgaagatgcttaaagatgtctgtttgctgaaaatatct

SEQ ID NO: 28852 - DNA, 1602 bp, Homo sapiens
attctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacctaagattcatttcatacgtttgatgcttagctgaaaaattacaataaattctccaatgaaattatgtatctttatttaatgaaaatgcctgctgcgtaccaagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaag

SEQ ID NO: 28853 - DNA, 1448 bp, Homo sapiens
ggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaatt

SEQ ID NO: 28854 - DNA, 1002 bp, Homo sapiens
cgaggcgctgccggctggagccactgtcaccacgcacatggtggcaggcgccgtggcagggatcctggagcactgcgtgatgtaccccatcgactgcgtcaaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaatt

SEQ ID NO: 28855 - DNA, 3670 bp, Homo sapiens
ttttttccttttctccagcggcctcaggttcttgttacaactgagtccgggttggaggaggtgtggggccgctgccgccaggaaaaacagcactggaggcaatgtttctataaatcaaagaagagacagtgtgagaatgtcagccctcaactggaagccgtttgtgtacggggggctggcctccatcactgctgagtgcggtacatttccaattgatttaaccaagacacggctccagattcaaggccagacgaatgatgcaaaatttaaggaaattagataccgaggaatgttgcacgcattagtgaggataggcagagaagaagggctgaaagcactctactcggggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgaaggttgcaaggtctgtattggtggggggtgttttcaagcagcttaggttctgtcttaggtcatgttagtaattagctttatgatttttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacagctctaaacagtctatgtagaagaggggcatgttctcatgggcttctcatggtaattgtgaatgaagccctttgttaaggtcttgttgaagaaagaacactgtataagttcaggctttagtacattttccttagcaaaatgttggtagtgaatcaaagagttgatttttccaggtttccagtttttactttagtttatgttgtgcctgtcttggactttctgtttagtttggatggaaaatacctgcttgaaattttaaaaatgatttctttagtgcatctatttagctagtttctgataggtggtatgtaatattttccctttttctttccttctgtagacacaataagtcattctccctcttctttttttctttttctattttcttattctttactctaacctgcttcagagaaagagccctcttccttcttgtcttcatcttagtcttttcaaaataaaagatgactgtgagaaccccaagaacttccacttctgggaggcagccacaggacagggaacatatttatttgggtctcttcagttccccctttgagaacaacattaaatacatgttagctggggctccagggcattctccttccacagtagtgcggccaaattcccagtctggccagtctctttgttgagactgaatagaaggactgcaggtttttttggaggatgagataatttttcctcgcaggcatttttcccttgccttccttatgcatgaatggtccctttgaatattatttccaaaagtgagagctaagacaaagtcatcaaaaagagaggataacagaaggtgggggcgggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaa

SEQ ID NO: 28856 - DNA, 2240 bp, Homo sapiens
ccttttctccagcggcctcaggttcttgttacaactgagtccgggttggaggaggtgtggggccgctgccgccaggaaaaacagcactggaggcaatgtttctataaatcaaagaagagacagtgtgagaatgtcagccctcaactggaagccgtttgtgtacggggggctggcctccatcactgctgagtgcggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatat

SEQ ID NO: 28857 - DNA, 1377 bp, Homo sapiens
ccttttctccagcggcctcaggttcttgttacaactgagtccgggttggaggaggtgtggggccgctgccgccaggtacatttccaattgatttaaccaagacacggctccagattcaaggccagacgaatgatgcaaaatttaaggaaattagataccgaggaatgttgcacgcattagtgaggataggcagagaagaagggctgaaagcactctactcggggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggact

SEQ ID NO: 28858 - DNA, 2891 bp, Homo sapiens
actagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaa

SEQ ID NO: 28859 - DNA, 2348 bp, Homo sapiens
atgacgggccagggccagtcggcgtccgggtcgtcggcgtggagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagcc

SEQ ID NO: 28860 - DNA, 1347 bp, Homo sapiens
ataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttgagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcct

SEQ ID NO: 28861 - DNA, 1448 bp, Homo sapiens
gcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtata

SEQ ID NO: 28862 - DNA, 2986 bp, Homo sapiens
tacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgtcgctgctgtggcccgagcagacgggctgtggggcctgcagaaggggctggctgccggccttctgtaccaaggcctcatgaatggcgttcgtttctactgctacagcctggcgtgccaggctggcctcacgcagcaaccaggtggcaccgtggttgcgggagccgtggcgggggcactgggagccttcgtggggagccctgcttacctgatcaaaacgcagctgcaagctcagacagtggccgcagtggccgtgggacaccagcacaatcaccagactgtcctgggtgccttggagaccatctggcggcagcaagggctcttggggctgtggcagggcgttggtggggctgtgccccgagtcatggtgggctcagctgcccagctggccaccttcgcctctgccaaggcctgggtacagaagcaacagtggctccctgaggacagctggctggtggccctggctgggggcatgatcagcagcatagccgtggttgtcgtcatgactcccttcgatgtggtcagcacgcggctatacaatcagccggtggacacagctggcaggggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggcccacccaggtccagagcatccacttcaagttaccacccattctgtcttccagacagttctcttccttctctgtactgcgtactgggtcaccacatcccagagccttgctcagttatagcaactgctgcgggcgtgcacatggcataggcccagtaacttacatacatcggctcacttaggcctcagacagcagcacgaggcaggcacttttacttcttttaccattagaaagccaaggcctagagtggtgggctttgaccacagccacacaattttgaagtggcagagccaggactggagcttagccctgctcaccctagacctatgcgcttgacaagtgcgtgactgtgacaggcccatgggcccggactgcccataggggtcactgtaccatggcaaaggctgaggtgcaccaggaggctgtggcgtcgtcacctgccttatttgctggagaagctgtagcaaagaaccacagactgggcgacttagacaatagaaatgtattttctcacagttctggaggctggatgctggagaccaaggtgtcagtgggctggtttcttctgaggcctctgtccatggcttgcagatgctgctttctctctgtgtctgcacatggtggtccctcgatgtgcgtctgggtcctgatctcctcctcttataaggacacaaatcatgttggcttagggcccaccctcatgaccccactttaatttttttttttttttttgagatgaagtctcactctgccacccaagctggagtgcagtggcacgatctcggttcactgcaaccttggcctcctaggttcaagcaattctcctgccccagcctcctgagtagctgggattacaggtgtgtgccaccacacccggccaatttttgtatctttagtagagatggggttttgccatgttggccagactggtctcgaactcctgacctcaagtgatccactggccttggcctcccaaagtgctgggattacaggcatgagccacctcacttggcccaattttaacttaattatctctgtcaagagcctatctccatatacagtcacatcctgagctactagggggtaggacttcaacatgcacttctgcaggggccgcagttcagccaacatcatctttttttttgagatggagtctcgctttgttgcccaggctggagtgcggtggtgcaatctcggctcaccacaacctccacctcccaggttcaagtgattctcctgcctcagcctcccgagttgctgggactataggtgtgcgccaccatgcccagctaattttgtatttttagtagagacaggctttcgctgtgttggccaggctggtcttgaatgcctgaccttgccgcccgcctcggcctcccaaaatgctgggattacaggcgtgagccaccgcgcctggcctcagccaacatcatctaagggctctcacggagggcctcccagctgcccgccctgtgggcatttgcacatatcctgacaagcctgaaagaagctccgggtgcccattgttcagtccaggtgcccattgttcccgggactgaggcccgggaaagggaagcgacgtggcagggccagcagcagaccctgggcctttctctagactgagcaccattccccgtgggtgtgctctcagcgccgcaccgaccttcacactgcagagatggatgccaactccctggcaggggcaggactgctgccgagcagccccacctgccctcccagccacaccccaagtctgtaagggccgctcccaggaacacctgctactgcacactccaaaccaataaagttttatattttgtttacttcaacgac

SEQ ID NO: 28863 - DNA, 2785 bp, Homo sapiens
ttactttcttactcttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatgagatacccgcccgttccttcctccttacgggggctgattgaaggtaagcaagagatcagtctggtactggggcagcctcagcaaggcctgatgaagtgtcacgtcctttgctacctaaggggatcagagtcaggatgcttacctggatctctgcgtccccgctaccgcccttccaggacattacacactctcgggccctcacctgctggttttccttagctatctgctgcttgccagagaggacccaggcttcttgacagcggcccctcagggccaggttctccaaactgagaggctgaacagactccacatggacagccctagccccctgcacgccaccaacatcctcaaagtggtacctggagtagggaagcggggtcaggaagggacatctctggtcgcctccccgggagcatctttaagttgcaggcctggctcccggcccgtgcgtggtctcaccgcccggattaaccgtcggccgcgggccccgcccactggtccgaccccgcccctgccattggccagccgggggccattccctcaccgcgcagccgcttcgccccgtacgtgggcctgcagctcgagaagttccactatcaggctctggtccgtcacgggatggcagaaaacttcttgattgtccgggaccggtcggaggtcgctggagtgaggcgaggcagaccctggttgaccccggtctcttcccacaacccacccagtcagccgcccctgggcgccccggccttctcaccttacgtcaatggcccccatggggaggatggcggaaaaggcgcccccgaacagcgggcagtctctcgtgggctccatgggtctgaggctgggttatgggcattagaaaggtttaaaagaagtccacattgggtcacgtggcatcggctccctgggtttcgcagctgccaccgccacccgggtctggcttagctcccggatcctttaagatttggctccgccctgcgctctcgttggccaatcggcgccaagaccctgggggcgggggtcagcggctttgctccggaagccgcgctcttaggagtgcgcctggcgggacggtggggtctgccttggggttggacttagggttagggtctatgtcgcccccggtggtcacgagcatgctcccgccagcctcctcttgattgattgattgattgattgattgacaggtctcgctgtgtcgcccaggctgtaatgcagtggcgcgatcaccgctcactgcagtctccacctccaggactcaagtgatactcctgcctcagcctcttgagtggctcctgctcccgccaccacgcccggctaaatttttaattacttgtagaaatggggcggggtggggagtgtctcccaatcttgcccaggctggcctcaaactcctggactcaagcgatcctcccgcctcggctccctaagtgctggaattacaggcgagagccacagcgcctggcctcctcgtccttttcaagtggtcacaccttccaagaaggtcgcctgagaccctcctgaggggcaggtgctcgtcaaaggggcccacgtctaggtagggtctcttgagtcaggaaagcatagtttcacggtgttctgggcctctgaaagaagaatgggctgccacccagaccgctaattcatagatctgctgctgggaattaggggaacaatgcgtccaggttaggattcaggtctcacatcttcctgaaagtgagagccaacctgggtattagaaatctaattcctctcaaatatttgccttgggaatgctcccgggcaggtgcaaccccacccccagctccacacacctggacagaagcacagattaaaccctcttttgtttgtctttt

SEQ ID NO: 28864 - DNA, 2211 bp, Homo sapiens
gagctccggtggctgcctggggacgctcagggacgctcattcctggccagagtcctgacttctttctcggatcgagatctcgttgctggctcgaggaaatcaccggctcttctcccggatccttttcttctctcacttgctggctttcttcttcctgcctccctggcttccatctcccaaccccgcgattccctcctctactcccgtgctcccgtcgcccgccatcctgagccatcccacctgcaaccttctgtcttttgcccctccttgacctcagagggtcctgccttaagcttctcaccagaatctcctagatttctatctcttccctgcttgccagctcttgactcccaaattccagctgacgtttgaccacttgacatttgaccctgacacccttgactgcaaatctaaattcttatcttctgcaacctgtactgctgaaacaggccttccccctgtcttccaaccccgctttctgacacccatttttactttcttactcttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagggcctcatgtaccgggggatactggacgctctgctgcagacagctcggaccgagggcatttttggcatgtacaaggaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatgagatacccgcccgttccttcctccttacgggggctgattgaaggtctcgctgtgtcgcccaggctgtaatgcagtggcgcgatcaccgctcactgcagtctccacctccaggactcaagtgatactcctgcctcagcctcttgagtggctcctgctcccgccaccacgcccggctaaatttttaattacttgtagaaatggggcggggtggggagtgtctcccaatcttgcccaggctggcctcaaactcctggactcaagcgatcctcccgcctcggctccctaagtgctggaattacaggcgagagccacagcgcctggcctcctcgtccttttcaagtggtcacaccttccaagaaggtcgcctgagaccctcctgaggggcaggtgctcgtcaaaggggcccacgtctaggtagggtctcttgagtcaggaaagcatagtttcacggtgttctgggcctctgaaagaagaatgggctgccacccagaccgctaattcatagatctgctgctgggaattaggggaacaatgcgtccaggttaggattcaggtctcacatcttcctgaaagtgagagccaacctgggtattagaaatctaattcctctcaaatatttgccttgggaatgctcccgggcaggtgcaaccccacccccagctccacacacctggacagaagcacagattaaaccctcttttgtttgtctttt

SEQ ID NO: 28865 - DNA, 1960 bp, Homo sapiens
gaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctgcaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtacttta

SEQ ID NO: 28866 - DNA, 1607 bp, Homo sapiens
ggggcctcgtggcgcggtgtaggggcggggcccccttggctgctttcggcgtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttctgc

SEQ ID NO: 28867 - DNA, 1610 bp, Homo sapiens
ggggcggggcccccttggctgctttcggcgtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttctgc

SEQ ID NO: 28868 - DNA, 1289 bp, Homo sapiens
ggcccccttggctgctttcggcgtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctcca

SEQ ID NO: 28869 - DNA, 4045 bp, Homo sapiens
gcctcgctctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataaagcactcgttaaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagtaaatctaattgcctagtcgtttttttaacacatatacatgcaatgtatctggatgaatagaaggctgaattgaagctttctttatatttaagaggtaaaaagaaatattaatacttttaaaatatactaacaaccaaaaagtgttcagaattttgctataataataatttgtattaaaatagtacctagaaaaattcagtctatggaataggtaaaattttaaaattttaatttgctctcagagttctgtctgataaaataattgaactataattggcatgatgaatattcccaggttttacttcagtatataaatttaactctcagccacatgggctttccagacttttcaatacatatgatgttgcaggaattgcaatatttgcaaacatgtgccacaacagtgttcttggtgatgtttctaaaacagtttttattctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgctttta

SEQ ID NO: 28870 - DNA, 1549 bp, Homo sapiens
aatcctcccactagacactcccgcatggtagctggagcagcaaacaactgcttagggatttgaagccaggtgtcctaacttcctccatgggcgctcagcctggggaacctcagaacacttgctctaggatccagacactgtttaggagggtcaagaccttactcatcaaagccccgcctcccccccaacctccgcctccacccccatcctggaaccctggctgtacacacgtgtatgggtacgcgtttggccacatgcatgacaacaaccttgaacatctcccgtcacagcaggtactggacacaggagagcagctgatggtccccgtggaagtcctggaagtggataacaaggaggccttgtggaagtttctactctcaggagctatggccggggcggtgtctcgcacgggcacggcacctctggacagagccaaggtgtacatgcaggtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcagtgcaagaattacttctgtggaatacaagggtccccgcccttccaggagcgtctccttgctggctccctggctgtggccatctcccagaccctcatcaaccccatggaggtgctgaagacgcggttgaccttgcgtcggacgggccagtacaaggggctgctggactgcgccaggcagatcttgcagcgagagggcacccgcgccctttaccgcggctacctgcccaatatgctcggcatcatcccctatgcctgcaccgacctggctgtctatgagatgctccagtgcttctgggtgaagtcaggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagattcctgaagctggggttggtggtgggtggaggggggcagtgctgggtcagaaaactcctgggactccctccccagggtgcagcctgagacaagaaacgtggactccagtctggccccttgtgggtcgtcctggctccagggcgaaatggtgaacatgtcacacaacaaggaataaagagatggtttttgctg

SEQ ID NO: 28871 - DNA, 1647 bp, Homo sapiens
aatcctcccactagacactcccgcatggtagctggagcagcaaacaactgcttagggatttgaagccaggtgtcctaacttcctccatgggcgctcagcctggggaacctcagaacacttgctctaggatccagacactgtttaggagggtcaagaccttactcatcaaagccccgcctcccccccaacctccgcctccacccccatcctggaaccctggctgtacacacgtgtatgggtacgcgtttggccacatgcatgacaacaaccttgaacatctcccgtcacagcaggtactggacacaggagagcagctgatggtccccgtggaagtcctggaagtggataacaaggaggccttgtggaagtttctactctcaggagctatggccggggcggtgtctcgcacgggcacggcacctctggacagagccaaggtgtacatgcagctactcgggaggctgaggcaggagaatcgcctgaacctgggaggcggaggttgcagtgagccgagatcccccgaccgcactccagcctgggcgacagagtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcagtgcaagaattacttctgtggaatacaagggtccccgcccttccaggagcgtctccttgctggctccctggctgtggccatctcccagaccctcatcaaccccatggaggtgctgaagacgcggttgaccttgcgtcggacgggccagtacaaggggctgctggactgcgccaggcagatcttgcagcgagagggcacccgcgccctttaccgcggctacctgcccaatatgctcggcatcatcccctatgcctgcaccgacctggctgtctatgagatgctccagtgcttctgggtgaagtcaggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagattcctgaagctggggttggtggtgggtggaggggggcagtgctgggtcagaaaactcctgggactccctccccagggtgcagcctgagacaagaaacgtggactccagtctggccccttgtgggtcgtcctggctccagggcgaaatggtgaacatgtcacacaacaaggaataaagagatggtttttgctg

SEQ ID NO: 28872 - DNA, 3132 bp, Homo sapiens
gaggcggggccgtggcggctggaggtagcggcggcggcgacgcgtccgggccggtgagggggcgcggggggcgccgggggggcccaagcgtcagcggcccgcgcctgtcgggctgaactgaggaccgagtctcctgccattccgagcaggcctggtatgggtaatggtgtgaaggaaggcccggtgcgattgcatgaggatgctgaggctgtcctgtcctcgtccgtctcatcaaagcgtgaccacaggcaagtgctcagctccctgctgtctggggccctggctggtgcccttgccaaaacagcggtagctcccctggaccgaaccaaaatcatcttccaagtgtcttcaaaaagattttctgccaaggaggccttccgggtcctctactacacctacctcaacgagggatttctcagcttgtggcgcgggaactcggccaccatggtgcgcgtggtgccctacgccgccatccagttcagcgcacacgaggagtacaagcgcatcctgggcagctactatggcttccgtggagaagccctgcccccttggcctcgcctcttcgccggcgcactggctggaacgacagccgcttcactgacctaccccctggacctggtcagagcgcggatggccgtaaccccgaaggaaatgtacagcaacatctttcatgtcttcatccgcatctcgagagaagaggggctgaagactctctaccatggatttatgcccaccgtgctgggggtcattccctacgctggcctgagcttcttcacctatgagacgctcaagagcttgcacagagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagaccgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggaaaatctgaggtacccaggggaacccccagctaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttcttctcctg

SEQ ID NO: 28873 - DNA, 2783 bp, Homo sapiens
cagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaagaaaaaa

SEQ ID NO: 28874 - DNA, 2273 bp, Homo sapiens
atggctacgtggaggcgggacggccgactgacaggcggccaaaggctgctgtgcgctgggctggcggggacgctcagcctcagcctcaccgcgcccctggagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttcc

SEQ ID NO: 28875 - DNA, 1032 bp, Homo sapiens
cttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctcc

SEQ ID NO: 28876 - DNA, 3482 bp, Homo sapiens
tttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccacttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 28877 - DNA, 1324 bp, Homo sapiens
agtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggc

SEQ ID NO: 28878 - DNA, 1290 bp, Homo sapiens
cagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccac

SEQ ID NO: 28879 - DNA, 2196 bp, Homo sapiens
agaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatga

SEQ ID NO: 28880 - DNA, 2214 bp, Homo sapiens
agatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaagctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 28881 - DNA, 2100 bp, Homo sapiens
agatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccgcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 28882 - DNA, 2286 bp, Homo sapiens
agatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 28883 - DNA, 3088 bp, Homo sapiens
actgcaacagctgcctctcgggttcaagcgattctcctgcctcagcatcccaagtagctgggactacaggcgcccgtcatcacacccggctaatttttgtatttttggtagagatggggtttcactatgttggtcaggctggtctcgaactcctgacctcaggtggtccttccgcctcggcctcccaaagtgctgggattacaggcgtgagccactgcgcctggcctgtatcagttatagtttttgcaaaggcagtttcaggaataagaagcagaaccaggactgcagcccaagccaccacgagaggccagtctttggggatggtcttttaggatgatctttgggggtggcccaaggagccccaggcagctccagaggcaggagtcactcaggatttattgagagcccaccctgtgccacccgctgtgcacagaacacccagagatccctgtccagacagacaagttcttcccatcgtatgttggcgtgataactgtgatggagaaagagaggaagagccagcagtgcctccggctggggaggcggggcagacctcacccaggtggtgacatttgagccccagctggaggggtgccagggcaagagtgcccaggaagagggaagagccagtccacaggcctggagacagaaggctgactgaagaagagtctggaggctcgggtggctgcagcagagaaagcaagggggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggtgagacatttttcttccttctgtcacatcacacccaatgggccctgcagttctgcgtggccagctggcagcagggcctgctctggatcccggcgacgacattatgagttgaagaaagaagagtaaagctctcggagagacttgcttcctgggcctggcacgagggccctcactcatagcaccctcttgtcaccacaggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatg

SEQ ID NO: 28884 - DNA, 2138 bp, Homo sapiens
ggggaattcaactctgtctcctctgctggagccaccagttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 28885 - DNA, 561 bp, Homo sapiens
cacagatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggct

SEQ ID NO: 28886 - DNA, 2385 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaa

SEQ ID NO: 28887 - DNA, 1575 bp, Homo sapiens
aagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagact

SEQ ID NO: 28888 - DNA, 2345 bp, Homo sapiens
acagtttttgaaatagttgtccaggactttaaaattggaagcttttatataaaatgagaatatctttttttgaaaaaattacaacttcaaaaccctgggcccacactctaatgtggcaacaatgaattggagtgaaagcgtaattgtgctttaaacactctacaccttgcaatttgccacagaccccagcagagtccttcattcatttaaattatttacctggcccctatcagaatttgactttgaggtttaaatgaacagcaggttaataaaataaattttttaaaattgttttgagactaaacctaaattgtcagtaattggttatcagtaatcttatttttttatttctatttttttttactttagaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaa

SEQ ID NO: 28889 - DNA, 1596 bp, Homo sapiens
ttttaatcctgttctttgtttccatatctattctctttcttttaaccaatcatcttaattttcttcctttaatttctcatgtttactttcataatcagttgtgcctcttgcttctctgccagccccttctatcagcacgtatgaaaacaccttgtatttttttctctcaaaccatcacagttgtttacactgtgttctagaaaagaaaatgttcaccattagaatatatttctcctacagattgaaaaaaattagaagttgattactgttttgaaaattgggctaattccagatgttttaaataacatggcttttgttttatttaagtttatttttatgttttagggaggttttacataaatggagtcctaaacaaataggagaacaccttctactgaaatcattgtgaattggaaatcccccagcttgctggctccctcagtgggacattccagcacattattacttagtgatgttccattcaccttgaaaaccactacttgccaggacctggcccataagggttagcctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatc

SEQ ID NO: 28890 - DNA, 1534 bp, Homo sapiens
gaaggaacataggatgaaaccatggaagtcttcctcagatctggggagggagcctggcccaagagcccgtggagctaatgaaaacagaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattg

SEQ ID NO: 28891 - DNA, 1546 bp, Homo sapiens
gaaggaacataggatgaaaccatggaagtcttcctcagatctggggagggagcctggcccaagagcccgtggagctaatgaaaacagaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaa

SEQ ID NO: 28892 - DNA, 2624 bp, Homo sapiens
gacgcggcggcggccgacgggaagctgtgtgtgcttaggtcgtggtggccccggtggtggtgggctccgggcgggctcgcgtcatcctgcccccgctgcgatgcatccgcggcgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgt

SEQ ID NO: 28893 - DNA, 8080 bp, Homo sapiens
gtgacggcctcggccgcgggcgtttacactggctctgcctccggcatctcttcgccggtgcgtcctcgccgcgcccgtaggtcccggcagccgggccccgcctccttcggagtccgagcgatgggcggggaaagggacaggcaggtatagctctgtcggcgccgcggtgtccacctcagtcaggccacggtggaagacgcgtgccgcggcgcctggttgcctgcagcggcccggacccgagaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcaggtagcgatgggcttctttcaagtgggttttgtttctgtctacctctcagatgccttgctgagtggatttgtcactggtgcctccttcactattcttacatctcaggccaagtatcttcttgggctcaaccttcctcggactaatggtgtgggctcactcatcactacctggatacatgtcttcagaaacatccataagaccaatctctgtgatcttatcaccagccttttgtgccttttggttcttttgccaaccaaagaactcaatgaacacttcaaatccaagcttaaggcaccgattcctattgaacttgttgttgttgtagcagccacattagcctctcattttggaaaactacatgaaaattataattctagtattgctggacatattcccactgggtttatgccacccaaagtaccagaatggaacctaattcctagtgtggctgtagatgcaatagctatttccatcattggttttgctatcactgtatcactttctgagatgtttgccaagaaacatggttacacagtcaaagcaaaccaggaaatgtatgccattggcttttgtaatatcatcccttccttcttccactgttttactactagtgcagctcttgcaaagacattggttaaagaatcaacaggctgccatactcagctttctggtgtggtaacagccctggttcttttgttggtcctcctagtaatagctcctttgttctattcccttcaaaaaagtgtccttggtgtgatcacaattgtaaatctacggggagcccttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagattaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaagaaaaccttctcttctatagtgtgtatgaagcgatggcttttgcagaagtatctaaaaatcagaaaggagtatgtgttcccaatggtctgagtcttagtagtgattaattgagaaggtagatagaagaatgtctagccaataggttaaaatttcaagtgtccaacatttcccagttccacagtgggaaattttgcacacttgaaattttaaccaagtggctagatattattcctcctttgaagctaatggcatttgtatatacacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttagaagtcacattcataaaacccaagtgctatgggtgtattattcatgatagctggcccacaggtcatgaattgaggaggaatttgctttcaaaaagcaagaatgtccaacactgaaagtttatagttttatatttggaccttgaaaggtaagaaaaaaccaggttctccaaagttaggaatagggaactaatttatgaaacagccatcttaaaaaaaaaaaaagtaaactgcaaaagtacaaaatcatttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcagcctcccagagtgttgggattacaggcgtgagccactgcacttggccaagttatttatttttaatctctcttgcccttctcccaaggcaggcttaagttgagactattataggtgtctaataacctgtgacagagtaatgagtacatgcttaagatgttataattagccaacaccaacacagcaaaaaatataattccagccaaagattctggaaaatccctcagaaggagggataacaggatttgacctttaccagcgatttctgtccatatgtggatgtaaacagttctggaacgttatgcatgcagttagcgaatccttgaattatgttctggtttgtacttgtcccatccatccaaacaagagattctgcttttggtagccatctgtagaaacatttaagatgtcactagaatttacatttcatcctctctacttgggttgaggttgcctatacttgcatattgttaaaatgttttggttgctgatattcagaggaatgaaacctggaaccaaagcctaatttgccgataaaaaaactgttttcggccaggtgcagtggctcatgcctgtaatcccagcacgttgggaggccgaggcgggtggatcacctgaagtcaggagttcgagaccatcctggctaacactgtgaaaccccgtctctactaaaaatacaaaaaattagcggggcatggtggcacgcgcctgtagtcccagctactcaggaggctgaggcaggagaattacttgaacccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggctgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggtttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttgatgtaattccatgtaaatcattgcttaaccctcttatgggatgaggatgagttattaatgtattgcagcctactggaaaggagggggagttggttaatagcagatacttttcttctagaagcttatgttttatgctgtttattatgtaagatcctgtatgtgtgttgagatttagaggtttcatttgttttgtctgctaataaattgttactctaataatacatta

SEQ ID NO: 28894 - DNA, 570 bp, Homo sapiens
tcttcgccggtgcgtcctcgccgcgcccgtaggtcccggcagccgggccccgcctccttcggagtccgagcgatgggcggggaaagggacaggcaggtatagctctgtcggcgccgcggtgtccacctcagtcaggccacggtggaagacgcgtgccgcggcgcctggttgcctgcagcggcccggacccgagaggtcagaaattgatgctgagtacagtgaagttttacaaaaccattgccatatgactgctgagcagtatagctgggatctgaacagagatctgtttgacttccagaacacatccagtgattctccaagtgtggtcctaagctcactcgttcagcatcatctagcgtgtggagtcctggatctcatccttggatttgcagggatggtcctaagaagctaacggctctctgtatttgacaattattgtactgtaatgtgctgcctcctaggggaagatctagaggaagctgaaccatctatctccagaaatgtcttcagaaagtaaagagcaacataacgtttcacccagagactcagctgaaggaaatgacagttatc

SEQ ID NO: 28895 - DNA, 2863 bp, Homo sapiens
cctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattcttgacttttcagcagtgtcctttcttgatgtttcttcagtgaggggccttaaatcgattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtaca

SEQ ID NO: 28896 - DNA, 2601 bp, Homo sapiens
gcacacagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtacagtgg

SEQ ID NO: 28897 - DNA, 552 bp, Homo sapiens
gcacacagagcctgtagacctgagtggatggacactgcctcttagaactagaacttagaactttatcttgaaaatgtaccactgttgcagaagctcctcacagagcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggc

SEQ ID NO: 28898 - DNA, 4930 bp, Homo sapiens
ctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttggaacatcaagacatatctcagttggaccttttccagtggtgagtttaatggtgggatctgttgttctgagcatggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaaccaaaaactacaatggagttctctctattatctatacgctggttgagatttttcaaaatattggtgataccaatcttgctgatttcactgctggattgctcaccattgtcgtctgtatggcagttaaggaattaaatgatcggtttagacacaaaatcccagtccctattcctatagaagtaattgtgacgataattgctactgccatttcatatggagccaacctggaaaaaaattacaatgctggcattgttaaatccatcccaagggggtttttgcctcctgaacttccacctgtgagcttgttctcggagatgctggctgcatcattttccatcgctgtggtggcttatgctattgcagtgtcagtaggaaaagtatatgccaccaagtatgattacaccatcgatgggaaccaggaattcattgcctttgggatcagcaacatcttctcaggattcttctcttgttttgtggccaccactgctctttcccgcacggccgtccaggagagcactggaggaaagacacaggttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaa

SEQ ID NO: 28899 - DNA, 600 bp, Homo sapiens
aggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttgga

SEQ ID NO: 28900 - DNA, 1471 bp, Homo sapiens
aaagctgtgcacatttcaggctgcagctgtcagcagcaggaacttctgctgctttcatttgagacggagcactgacaagctctccagagcacatggtcttcagcgggtgcaggcaaatctcaaactgctgatgtccattctcctgatgttacctccaggctcaaatgaggcatgggctggctgtcccatcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtg

SEQ ID NO: 28901 - DNA, 1726 bp, Homo sapiens
tattgcctcaggctgacccaactataatctaaatataaatgatcaatttgccaggtagagcaagtgctttctaattttctgtttatatttgctgtgtctgtctcccgtaactcagaccttttgcactagacagtacttgtgctcaacaaaatcttcccagttgtttcctctctgattgctttgcttgtagttccctgtctccttttcttctttgtttcagagcttctaatcttcatcttggctctgccccagctgtctcaacagagaattcattggtcatctaatcaaacgagagagtagtccccaccccctcagcctctctcctaactagtatggatcttaggagagctatttttgccagcgaaggttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgt

SEQ ID NO: 28902 - DNA, 1440 bp, Homo sapiens
gtgcacatttcaggctgcagctgtcagcagcaggaacttctgctgctttcatttgagacggagcactgacaagctctccagagcacatggtcttcagcgggtgcaggcaaatctcaaactgctgatgtccattctcctgatgttacctccaggctcaaatgaggcatgggctggctgtcccagttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggc

SEQ ID NO: 28903 - DNA, 2689 bp, Homo sapiens
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 28904 - DNA, 2474 bp, Homo sapiens
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 28905 - DNA, 2270 bp, Homo sapiens
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatgcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacg

SEQ ID NO: 28906 - DNA, 1404 bp, Homo sapiens
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctaggctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 28907 - DNA, 2174 bp, Homo sapiens
agagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggat

SEQ ID NO: 28908 - DNA, 2270 bp, Homo sapiens
agagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggat

SEQ ID NO: 28909 - DNA, 2422 bp, Homo sapiens
tcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaa

SEQ ID NO: 28910 - DNA, 2498 bp, Homo sapiens
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 28911 - DNA, 1947 bp, Homo sapiens
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 28912 - DNA, 2374 bp, Homo sapiens
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacg

SEQ ID NO: 28913 - DNA, 2588 bp, Homo sapiens
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaag

SEQ ID NO: 28914 - DNA, 2242 bp, Homo sapiens
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 28915 - DNA, 2317 bp, Homo sapiens
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 28916 - DNA, 2729 bp, Homo sapiens
aaagaggctttctcaccagccaaagttcaggtactgcccctgtctgagtttggacatgtggcccacagatgccagctgggggctggaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 28917 - DNA, 2545 bp, Homo sapiens
ggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 28918 - DNA, 2589 bp, Homo sapiens
ctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 28919 - DNA, 2630 bp, Homo sapiens
ggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaa

SEQ ID NO: 28920 - DNA, 2584 bp, Homo sapiens
ggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcaggatctgctctccaggctgcactgctaccattctaccctaggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 28921 - DNA, 2460 bp, Homo sapiens
ctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggcaaccccaggacccctgcctctcctgactgcccctggccgccccacaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctattgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctca

SEQ ID NO: 28922 - DNA, 3547 bp, Homo sapiens
ggggcggggctggagcggcccgcggcctcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggagtggagggtaaggcagggatggcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggttggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccgatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtc

SEQ ID NO: 28923 - DNA, 723 bp, Homo sapiens
ccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacgtggcacggcccatcctggactgagaaactggaacctcagaggaacccgtgcctctctgctgccttggtgcccctgtgtctgcctcctctccctgcttttcagcctctgtctccttccatccctgtccctgtctggccttaa

SEQ ID NO: 28924 - DNA, 2184 bp, Homo sapiens
aacgctggaaaggtcggccaaggagagcagaaaacaagcagtggtggagtcggcagtggggcagaggagggggagctggaagggaaggaccccaaagcagaagcccgcacagtaggcacagcgcacccaagaagggtccaggagtctgcagaaacagaaaggtccccggcctcagcctcctagtccctgcctgcctcctgcctgagcttctgggagactgaaggcacggcttgcagcttcaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggagtggagggtaaggcagggatggcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctga

SEQ ID NO: 28925 - DNA, 2394 bp, Homo sapiens
agtcctgcccggaacccccggcaacgcgcatacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggaagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaacatgtgagatggcactg

SEQ ID NO: 28926 - DNA, 2181 bp, Homo sapiens
acacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggaagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaa

SEQ ID NO: 28927 - DNA, 3351 bp, Homo sapiens
aaaaggtctgtcatcctccagttgaagtctgtgtgcctaccaagaatggccggaggactcgctgcttgacgggagggatgctccagcttggtctccagggacaactgtacctggagataaagtctggataccagggagggacagagatgctcttccttccacagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagcatttgctggctggccccaattattgtacccttgcccaaagggaggggcctctgtcgtgacccctcagaaatctggcagtctgggtttccacctttcccctatttaactctcagcccccacccatcccctggggttgcggctggcaggccgggacttgcagaaccaaatgggccaggggccaagttcattcttttgggagagagcaatggtaccttcccttaacgggaaaacgagaaatattgaggggaagatggactgcgatccaaacgccctggctctcaggcctggactctagggcttagccagatgcctaaaccgcccaagccgagaaacaacttagaagacagacataaccctgggattcagggaaggcgcgagcaccgcccaggacctggtagggtgcgagccgcgagcagtccgggagggagcgcgcctagggcggagcgtaggctgtggggggagggctgggagtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctaca

SEQ ID NO: 28928 - DNA, 2410 bp, Homo sapiens
cacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacct

SEQ ID NO: 28929 - DNA, 2781 bp, Homo sapiens
gctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatctttggcggcctggtcctcctgaaggtgaaggcaaaggtgcgacagtgcctgcaggagcggcggacagtgcccattttgtttgcctctaccgttcggcgccaccccgacaagacggccctgatcttcgagggcacagatacccactggaccttccgccagctggatgagtactcaagcagtgtagccaacttcctgcaggcccggggcctggcctcgggcgatgtggctgccatcttcatggagaaccgcaatgagttcgtgggcctatggctgggcatggccaagctcggtgtggaggcagccctcatcaacaccaacctgcggcgggatgctctgctccactgcctcaccacctcgcgcgcacgggcccttgtctttggcagcgaaatggcctcagccatctgtgaggtccatgccagcctggacccctcgctcagcctcttctgctctggctcctgggagcccggtgcggtgcctccaagcacagaacacctggaccctctgctgaaagatgctcccaagcaccttcccagttgccctgacaagggcttcacagataaactgttctacatctacacatccggcaccacagggctgcccaaggccgccatcgtggtgcacagcaggtattaccgcatggctgccctggtgtactatggattccgcatgcggcccaacgacatcgtctatgactgcctccccctctaccactcagcaggaaacatcgtgggaatcggccagtgcctgctgcatggcatgacggtggtgattcggaagaagttctcagcctcccggttctgggacgattgtatcaagtacaactgcacgattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgggggcctgtggtttcaatagccgcatcctgtccttcgtgtaccccatccggttggtacgtgtcaacgaggacaccatggagctgatccgggggcccgacggcgtctgcattccctgccagccaggtgagccgggccagctggtgggccgcatcatccagaaagaccccctgcgccgcttcgatggctacctcaaccagggcgccaacaacaagaagattgccaaggatgtcttcaagaagggggaccaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctccta

SEQ ID NO: 28930 - DNA, 1557 bp, Homo sapiens
ggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtc

SEQ ID NO: 28931 - DNA, 2361 bp, Homo sapiens
agcagtgccagggccaccacccctggggaggagccattgggctactcttgaggggccagaggtgagcctgaacactccacagctgctgctcctagggaggagctggtaccatgggtgtcaggcaacagttggccttgctgctgctgctgctgctcctgctctggggcctggggcagccagtgtggccagtcgctgtggccttgaccctgcgctggctcctgggggatcccacatgttgcgtgctacttgggctggccatgttagcacggccctggctcggcccctgggtgccccatgggctgagcctggcagctgcggccctggcactaaccctcctgccagcacggctgcccccaggactacgctggctgccggctgatgtgatcttcttggccaagatcctccacctgggcctgaagatcaggggatgcttgagccggcagccgcctgacacctttgtagatgccttcgagcggcgagcacgagcgcagcctggcagggcactcttggtgtggacggggcctggggccggctcagtcacctttggtgagctggatgcccgggcctgccaggcggcatgggccctgaaggctgagctgggtgaccctgcgagcctgtgtgccggggagcctactgccctccttgtgctggcttcccaggccgttccagccctgtgtatgtggctggggctggccaagctgggctgcccaacagcctggatcaacccgcatggccgggggatgcccctggcgcactctgtgctgagctctggggcccgggtgctggtggtggacccagacctccgggagagcctggaggagatccttcccaagctgcaggctgagaacatccgctgcttctacctcagccatacctcccctacaccaggggtgggggctctgggggctgccctggatgcagcgccctcccacccagtgcctgctgacctgcgtgctgggatcacatggagaagccctgccctcttcatctatacctcggggaccactggcctcccgaagccagccatcctcacgcatgagcgggtactgcagatgagcaagatgctgtccttatctggggccacagctgatgatgtggtttacacggtcctgcctctgtaccacgtgatgggacttgtcgttgggatcctcggctgcttagatctcggagccacctgtgttctggcccccaagttctctacttcctgcttctgggatgactgtcggcagcatggcgtgacagtgatcctgtatgtgggcgagctcctgcggtacttgtgtaacattccccagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcac

SEQ ID NO: 28932 - DNA, 2636 bp, Homo sapiens
ataagctgcactgcatggttgctgctggatgtgttgtgttcctggcttccctctggatgctgacagaaacaaggctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaagggttcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgttta

SEQ ID NO: 28933 - DNA, 1360 bp, Homo sapiens
agggcccacaacgatgtgaaggttataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagagggatcccaggccatggagcaaggagggcccgaatcagtacctccctcagatcacctggacagtgtgagacaaaaagccgcagggaccatccctggagggggattcagcaggctcgatcggggtccaggtgctggtatttttcattagcctccaggggattctgatgtagccagcagcgtccttggacaacagtttgagatctgctgcttttcaaactggattccttggagcgctggaaatctcagcgatgtcacagggcaggagagggaggttgtggagggaaaattcagacttcccgcccagcccaccatttcaccaggcagctctaaatttatgtgttttataagccaaggttcacacaaaaaagaaaattcgctgggggaaaaaaacagtttctatggcttaaaaaaaagtctgaagaccaccagtctatttcaatactctattttgttgatgaagaagctggtgaccaaagatacccaaagactaagtcagggggatgcaggggtacaggggtgcctctcactttcccaaagtgagatccacataccacagcaaaatgatttgagccagcctgtggatgaacacatttaaaattttatttataaatacatttactgttacatttgacttctctttattaaatacatttgtgatttatttttgcaa

SEQ ID NO: 28934 - DNA, 2750 bp, Homo sapiens
gctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaagggttcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgtttaga

SEQ ID NO: 28935 - DNA, 1934 bp, Homo sapiens
acaacgatgtgaaggttataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccagacgaggtcttgctatgttgaccaggctggtcttgaactcctggccttaaatgatcctactgccttggcttcccaaagtgctgggattacaggatattcaaaagtacacctgccgagtcccagccctga

SEQ ID NO: 28936 - DNA, 2237 bp, Homo sapiens
caacgatgtgaaggttataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagaggatattcaaaagtacacctgccgagtcccagccctgaggagtgttttcgtgcttcattgttaagtatcttggaggctctcagctggaaataaatgctcttcatttattaaagaagcatccttatatttttaagagtctttg

SEQ ID NO: 28937 - DNA, 1300 bp, Homo sapiens
gctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggctagaaaaattgtga

SEQ ID NO: 28938 - DNA, 1590 bp, Homo sapiens
acaacgatgtgaaggttataagctgcactgcatggttgctgctggatgtgttgtgttcctggcttccctctggatgctgacagaaacaaggctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttggggtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttct

SEQ ID NO: 28939 - DNA, 2464 bp, Homo sapiens
tttcagtccttcactgaggagccagagggaatcaattccacaagctgggttgaggagaacaggagatggagaaagcaagtggaagacagtccattgctctgtccacagtggagactggcacagtgaacccggggctggagctcatggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagcttgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatgggtgtttgcaggagtctccttggttggccttatactgtggttggctttagacacagcccaaaggccagagcagctgatcccctttgcaggaatctgcatgttcatccttatcctctttgcctgctccaaacaccacagcgcagtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggccttgtgcaatgggtagttcagaaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggaggagtccaagttcaagagtgaggagggggtaaagctgccccgtgggaaggagaggaatgtcctggaagctgccagcaacggagccgtagatgccataggccttgctactaatgtagcagccaacctgattgcctttttggctgtgttggccttcatcaatgctgccctctcctggctgggggaattggtggacatacaggggctcactttccaggtcatctgctcctatctcctaaggcccatggttttcatgatgggtgtagagtggacagactgtccaatggtggctgagatggtgggaatcaagttcttcataaatgagtttgtggcttatcagcaactgtctcaatacaagaacaaacgtctctctggaatggaggagtggattgagggagagaaacagtggatttctgtgagagctgaaatcattacaacattttcactctgtggatttgccaatcttagttccataggaatcacacttggaggcttgacatcaatagtacctcaccggaagagtgacttgtccaaggttgtggtcagggccctcttcacaggggcctgtgtatcccttatcagtgcctgtatggcaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcagtggctcatgcctgtaatcccagcactttgggaggccgaggcgggcggatcacaaggtcaggagatcgagaccatcctggctaacacagtgaaaccccgtctctactaaaaatacaaaaaattagccgggagtggtgtcgggcgactgtagtcccagctactcgcgaggctgaggcaggagaatggcgtgaatccgggaggcggagcttgcagcgagccaagatcgcgccactgcactccagcctgggtgacagagcgagactctgtctca

SEQ ID NO: 28940 - DNA, 4887 bp, Homo sapiens
cccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaataagaagcagagctgtgcaaagcagggagcacacaaacaccaaacaggatgaagaacaggtcacagttgagcaggattctccaagaaacagagaacacatggaggatgatgatgaggagatgcaacaaaaagggtgtttggaaaggaggtatgacacagtatgtggtttctgtaggaaacacaaaacaactcttcggcacatcatctggggcattttattagcaggttatctggttatggtgatttcggcctgtgtgctgaactttcacagagcccttcctctttttgtgatcaccgtggctgccatcttctttgttgtctgggatcacctgatggccaaatacgaacatcgaattgatgagatgctgtctcctggcagaaggcttctaaacagccattggttctggctgaagtgggtgatctggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatagcttttgattggttgggcagacaagttcagacttttctggagtacacagatgctggtgcttcatttgtctttggtgagaaatacaaagaccacttctttgcatttaaggtcctgccgatcgtggttttcttcagcactgtgatgtccatgctgtactacctgggactgatgcagtggattattagaaaggttggatggatcatgctagttactacgggatcatctcctattgaatctgtagttgcttctggcaatatatttgttggacaaacggagtctccactgctggtccgaccatatttaccttacatcaccaagtctgaactccacgccatcatgaccgccgggttctctaccattgctggaagcgtgctaggtgcatacatttcttttggggttccatcctcccacttgttaacagcgtcagttatgtcagcacctgcgtcattggctgctgctaaactcttttggcctgagacagaaaaacctaaaataaccctcaagaatgccatgaaaatggaaagtggtgattcagggaatcttctagaagctgcaacacagggagcatcctcctccatctccctggtggccaacatcgctgtgaatctgattgccttcctggccctgctgtcttttatgaattcagccctgtcctggtttggaaacatgtttgactacccacagctgagttttgagctaatctgctcctacatcttcatgcccttttccttcatgatgggagtggaatggcaggacagctttatggttgccagactcataggttataagaccttcttcaatgaatttgtggcttatgagcacctctcaaaatggatccacttgaggaaagaaggtggacccaaatttgtaaacggtgtgcagcaatatatatcaattcgttctgagataatcgccacttacgctctctgtggttttgccaatatcgggtccctaggaatcgtgatcggcggactcacatccatggctccttccagaaagcgtgatatcgcctcgggggcagtgagagctctgattgcggggaccgtggcctgcttcatgacagcctgcatcgcaggcatactctccagcactcctgtggacatcaactgccatcacgttttagagaatgccttcaactccactttccctggaaacacaaccaaggtgatagcttgttgccaaagtctgttgagcagcactgttgccaagggtcctggtgaagtcatcccaggaggaaaccacagtctgtattctttgaagggctgctgcacattgttgaatccatcgacctttaactgcaatgggatctctaatacattttgaggtcagccacttctccagtggaactctgaagtacagatgctgaattttctgctttggaaagaaaaaaaaaagaagctattgtccacagattgatgcttccataatggaatcagctttaattgcaaggaatgaagaaaaacaagagtggaccttcaaagctacaacattttcctcctcccctccctccccaccagccccttccccaccaagaactgctatgatgtcccaaagtgaggtgttgttgattccagtctcaatgggattttctgactttaatgtttgcaaggcatttcaccagaatacagctataaacggccgctcccaacaactgggctctgactcacccacacccacttagtgtccactaagtagtccagggtgactcagtttaagcacatctcaggtgaggtcactctgcatataccttggcttacctgaaatagcctgaacttgaatctcacataagggaaaactagtcatcaatcaccaactcattgactaccctcaggaagtcctgcagaaatcaagagtccttgaggagaacacgtggatcataccaaaaccagggtttaaatccattctgcttaagagttctatcagtcagtttaaccataaattacgctacagaaacaaacaacccaaaaacctcagtggcttacagatttatttttcactcacatgtttgtaatgatccatcttggttgtaatccatattgcttcagcacccagtctaaaggagcagcctctaaggggggcatgttggtcttaagagggaaaagaaaggtgggaaccacatgatggctctttcatcttccgctaggaaatgataccctttacttccatgacattccattagccaaaacaagtcctgtgacaggcacgatgtcagtcaccacagttaaattatcctgtcatagggagggatagtgaatattttgcagaagtaatatgatacaccataagggtacataatatccatgtctcccttcaaggagccatcctgttgtaggccataacggtaggcctattcatctgcacatttggtaatgtattcctggtgacaaagcagctactcttcaatcaaaagccgtgtaagaagcagttgaggaaaaaaagtcctggttgagctctgaaaaccttgcgttgataatttcattgaccaggatggcatcagtatcaaacttgaagaatgggtgtcagtgtctaagaaaaagattccagagacaatggtggtgtgctctttaacgaaatgcccatcaccactgctcttaatagcatgaagaccacatgctgtgagaaaacacaaacatcaattaccaagtcaagaaacagacactgaatgtgaaaaaggttttgaaataccttaagtaatttattttgtttctatttttccttctgtttgtgtacaagagtaatttaaaagaaaaagctatgtgaaaatagttggggttttttgtgtgttttgttttttgtggtggtgaaggaggaggcctaatgtccagaggactgtttatccctgaagtatgatatactaaaatatttcttattatttgtatcaattttccttggagctcaatgtgcccttgcagtcttcagactttattttaggaaaatatatttgcatgttttccccccattctcaatgtttggtgtcctggttcatcataccccacagaatgttatgtttatgtatcataccattcctctgtggacatgcatttactttgtttacaggttttggtttgggggttctctttttcctactctggacagtgcatgtacatttactttgcatgctggtgcttttttttctatagcaatagtgtctgatagacatatgcaagtcacatgtaatttaagatctagtagccacgctaaaaaacaagtaaaattaattttaatatatttaactcaatacattggagatattatttcagtaagatatttttcattcttatgaaactaagtctgtctggtttgcatatctcagttgagacactaaagttttactgataatacttaatccatgtttagatttcataaaatctaaatttgcaaagtaaatttacatacccatgttggtctaaatgtgcttaaaagttttccaataactgaaatgagtatcagttttaaatttaaaaatttgttacttggttactccatatttcaggtattagtggctaccatattggtcagagcagattcataggatgatttcccaggtttgaagtgtgtgtatatttctggtattataagatgtcagactggtttttggagaaatatgttgtcttaatttttacctgctttgatatgacctttctgtgtgtacgtgtgacatttctttataaatgcaacatgttcacataggtcctacgttgattccttattaatgctgtgcatccttgaactgagaaagggggtgttattcctgagctatattataagaggatagtaaaggccaaggaccaggaaaatgagctggttaagcctcttgagcttgttacccccagaaacctcaccaataccctgtgaacgtcgtaagtggcccttctcccagtgaaacaacctaatggaggtttttggtgcatggtgatgtttttattcctctttagtagacatagaagctggaggctgcttgtcttccccagtttctccttcacccatgtacatatagtgggcaaagatggcatgcctatgtttttcagctgtttgagcccgctcactgttgacagattgttgctgttggtctgtgctccccaac

SEQ ID NO: 28941 - DNA, 2481 bp, Homo sapiens
aactgaagcaagctgtgcccaggtccctgtaacagcaggtggctttctgacatcagcagagactggtgctttttcccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaataagaagcagagctgtgcaaagcagggagcacacaaacaccaaacagagaatcaaaggccacattggatatgacagaagacaagtgctgagatttgacattatacttcttagagcacactcaaactgctccacctccatctatttcctcccccaccagcttctgtaccattggttacaagagccaggcttattatttgagacattattggagactggagacaggatgaagaacaggtcacagttgagcaggattctccaagaaacagagaacacatggaggatgatgatgaggagatgcaacaaaaagggtgtttggaaaggaggtatgacacagtatgtggtttctgtaggaaacacaaaacaactcttcggcacatcatctggggcattttattagcaggttatctggttatggtgatttcggcctgtgtgctgaactttcacagagcccttcctctttttgtgatcaccgtggctgccatcttctttgttgtctgggatcacctgatggccaaatacgaacatcgaattgatgagatgctgtctcctggcagaaggcttctaaacagccattggttctggctgaagtgggtgatctggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatagcttttgattggttgggcagacaagttcagacttttctggagtacacagatgctggtgcttcatttgtctttggtgagaaatacaaagaccacttctttgcatttaaggtcctgccgatcgtggttttcttcagcactgtgatgtccatgctgtactacctgggactgatgcagtggattattagaaaggttggatggatcatgctagttactacgggatcatctcctattgaatctgtagttgcttctggcaatatatttgttggacaaacggagtctccactgctggtccgaccatatttaccttacatcaccaagtctgaactccacgccatcatgaccgccgggttctctaccattgctggaagcgtgctaggtgcatacatttcttttggggttccatcctcccacttgttaacagcgtcagttatgtcagcacctgcgtcattggctgctgctaaactcttttggcctgagacagaaaaacctaaaataaccctcaagaatgccatgaaaatggaaagtggtgattcagggaatcttctagaagctgcaacacagggagcatcctcctccatctccctggtggccaacatcgctgtgaatctgattgccttcctggccctgctgtcttttatgaattcagccctgtcctggtttggaaacatgtttgactacccacagctgagttttgagctaatctgctcctacatcttcatgcccttttccttcatgatgggagtggaatggcaggacagctttatggttgccagactcataggttataagaccttcttcaatgaatttgtggcttatgagcacctctcaaaatggatccacttgaggaaagaaggtggacccaaatttgtaaacggtgtgcagcaatatatatcaattcgttctgagataatcgccacttacgctctctgtggttttgccaatatcgggtccctaggaatcgtgatcggcggactcacatccatggctccttccagaaagcgtgatatcgcctcgggggcagtgagagctctgattgcggggaccgtggcctgcttcatgacagcctgcatcgcaggcatactctccagcactcctgtggacatcaactgccatcacgttttagagaatgccttcaactccactttccctggaaacacaaccaaggtgatagcttgttgccaaagtctgttgagcagcactgttgccaagggtcctggtgaagtcatcccaggaggaaaccacagtctgtattctttgaagggctgctgcacattgttgaatccatcgacctttaactgcaatgggatctctaatacattttgaggtcagccacttctccagtggaactctgaagtacagatgctgaattttctgctttggaaagaaaaaaaaaagaagctattgtccacagattgatgcttccataat

SEQ ID NO: 28942 - DNA, 2283 bp, Homo sapiens
acaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcagggacctgagggagctcagggagggagagaagccagaagaccaggcagagactgaagagagctggcaaggcctggctagaaaaactccaggcaaggcctgtgcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttc

SEQ ID NO: 28943 - DNA, 2159 bp, Homo sapiens
agggggtcttactggactcctccactggcctgttctgtcagccctgccccctctccccctaagagcctgaggaggcctatggcagggccaagacagggcctcacactgttcctgcccccagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28944 - DNA, 2168 bp, Homo sapiens
ggagcctgaggaccctgcggggaccgggacccaagctgggcggggcggcctggctcccgggcctaaaacaggctgcggtcacgttgacctccgcaaggggcaggcgagtggacgggtgatccccatcgatctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28945 - DNA, 2275 bp, Homo sapiens
ggagcctgaggaccctgcggggaccgggacccaagctgggcggggcggcctggctcccgggcctaaaacaggctgcggtcacgttgacctccgcaaggggcaggcgagtggacgggtgatccccatcgatctggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28946 - DNA, 2258 bp, Homo sapiens
cagcgcgggagcagtgcttctgcggcaggcttctcagaatggggccccatgaagcctgagggactctctcctgataacaccctgtgccacctttttcattctggatccgcacccaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28947 - DNA, 2219 bp, Homo sapiens
gaatgtgccccggcgggagagggaagctgcagcgagagcgcgcggatctcagcgcgggagcagtgcttctgcggcaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28948 - DNA, 2112 bp, Homo sapiens
gaatgtgccccggcgggagagggaagctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28949 - DNA, 2485 bp, Homo sapiens
agtgcttctgcggcaggtgctgcccggggccggggactggggactggggactgccggggcggaagacgccgctgcccgcctgccacggagggcagggagggcgggcctgacggctccgcagcccggagaagggacgccgggtggggccccagtgcggagcgtgcggagccgcgcagcacgtggcgcgcacgggccagggagcctgaggaccctgcggggaccgggacccaagctgggcggggcggcctggctcccgggcctaaaacaggctgcggtcacgttgacctccgcaaggggcaggcgagtggacgggtgatccccatcgatctggagcccgtggacaaggcccactgcctgagcctgaactaggagcacctcctagggactgcccaggcttgctctgctctgacccttctgctggccagtctgggcacctgcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggct

SEQ ID NO: 28950 - DNA, 2326 bp, Homo sapiens
gaagggcccctcccactgagtcggctctggtctccccgcccctgagccgcgaggactggacgcagctggctgcggagctctgggcgggcgctggggtcgcctgttgcagcctctcttccgcccggcggcccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggct

SEQ ID NO: 28951 - DNA, 2162 bp, Homo sapiens
gggctgcgctctccagctgtggctatggccccagccccgagatgaggagggagagaactaggggcccgcaggcctgggaatttccgtcccccaccaagtccggatgctcactccaaagtctcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 28952 - DNA, 846 bp, Homo sapiens
gaagggcccctcccactgagtcggctctggtctccccgcccctgagccgcgaggactggacgcagctggctgcggagctctgggcgggcgctggggtcgcctgttgcagcctctcttccgcccggcggcccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattgtaagctgggccaggagggggcctatgggaggaggcatgcccaactacccccactcttttttgacccagcgttagccagagagaagcccagcctccgcctggagggagtggatgctgtgagcagctgggattcagaggcctga

SEQ ID NO: 28953 - DNA, 2514 bp, Homo sapiens
ggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgt

SEQ ID NO: 28954 - DNA, 2505 bp, Homo sapiens
acgctctgggcggggactccgcagcggctccctagttagggggcgccccggtgggttccagctttaggggtcgcaggagcggctctggcatcacctcggagctgacgaagcgggaagagccccgcaccagtgctgcccctacagagctctcggcggggggtggaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgt

SEQ ID NO: 28955 - DNA, 2509 bp, Homo sapiens
gtggcagctctggttcccccgcccgggcccggctcgggttacgctctgggcggggactccgcagcggctccctagttagggggcgccccggtgggttccagctttaggggtcgcaggagcggctctggcatcacctcggagctgacgaagcgggaagagccccgcaccagtgctgcccctacagagctctcggcggggggtggaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttg

SEQ ID NO: 28956 - DNA, 2257 bp, Homo sapiens
cagtggtcctggccgtgcgccggaggcagcggcggcgtggcgcagcggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacacttcctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccactgtcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccatctgcaccaacatcgagtccctcaacaagggttcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaa

SEQ ID NO: 28957 - DNA, 1904 bp, Homo sapiens
cagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatg

SEQ ID NO: 28958 - DNA, 1993 bp, Homo sapiens
gcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgca

SEQ ID NO: 28959 - DNA, 2161 bp, Homo sapiens
accgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgca

SEQ ID NO: 28960 - DNA, 2222 bp, Homo sapiens
attgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacagtagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 28961 - DNA, 2397 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctc

SEQ ID NO: 28962 - DNA, 1736 bp, Homo sapiens
gcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctctttttta

SEQ ID NO: 28963 - DNA, 589 bp, Homo sapiens
gcaagccttggtgggggaaaaggcagaagttgtgactggctgcctctgagagtgcaagtagccatgcaaagttgggaaaaccagacggcggccggagccgtgaaccaggggcaaatggaggatggtgttggggtagtcactagcctgccggaatggaagaagaggggcgtttgggggcggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccac

SEQ ID NO: 28964 - DNA, 2989 bp, Homo sapiens
gaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaa

SEQ ID NO: 28965 - DNA, 2184 bp, Homo sapiens
cactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagt

SEQ ID NO: 28966 - DNA, 2240 bp, Homo sapiens
atggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattg

SEQ ID NO: 28967 - DNA, 5474 bp, Homo sapiens
cctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaaaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 28968 - DNA, 2494 bp, Homo sapiens
cggggcgcagcggctgacccgagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttggtgggtacctggcacacagcttggctgtcatgactgacgcagcacacctgctcactgactttgccagcatgctcatcagcctcttctccctctggatgtcctcccggccagccaccaagaccatgaactttggctggcagagagctgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagta

SEQ ID NO: 28969 - DNA, 3097 bp, Homo sapiens
gagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagtacctgtggttgttgaagattggttacttttaccatcctggggacagggaactctgtggcccgaggctgcctcactgaggagtcaggtgggcttcccagcctccccaggggcagtgctgagtttgtcttgactgttctggcccaaggtgggaggaggtgggtttggtcacttgcctcccactttaaatctctgtctttccatctgtgaaatgacctctttgtgccttcccagcactgtcatcctgatcgcctgtgttctaggtaggtgggtccttcagcccctccaggtctgtgaaaagtctgtggaaagcactggcctggagaggggtggggggttgctggtgggtgctccattccaccacaatctcaggggactcaacctcccctacccaactccccacccccacccaagccatggcaggccccaggaacttgatcctgggctttgccgtatgccaagtccttacacccctctcaagagacagtcattggctgggcacggtggctcatgcctgcaatcccagcaccttgggaggctgaggcaggcagatgacttgaggccaggagttcgagaccagcctggccaatatggcgaaacctcatttctactaaaaatacaaaaactagccaggcgtggtggcttgtgcctgtaatcccagctactcgggaggctgaggcaggagaatcgcttgaaccggggaggcagaggttgcagtgagctgagatcacaccactgcactccagcctgggtgacagagcgagactccagctt

SEQ ID NO: 28970 - DNA, 2260 bp, Homo sapiens
gggacggggctgtggagatgaggagttctccagaactcgggtggcggggcgctcccgggctctggcgcggggaaatggggctttggcagtgggggcggggcttaagggtggggagaggccggggagcctggaggcggagcttggggagctcgccccacgcggggcggggctccggcggcagcgggatctgcagttcggactccgcgcgccacagtcgctgcagttcgctccactctggtggccccgccgccctgcggggatcccgggggtcggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgca

SEQ ID NO: 28971 - DNA, 590 bp, Homo sapiens
gagggcttagcaggcctgcggcccaaggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggc

SEQ ID NO: 28972 - DNA, 899 bp, Homo sapiens
gactgtcacagcttcgagtgcacaatcctcttcccaccccctcccattctacagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttctt

SEQ ID NO: 28973 - DNA, 1504 bp, Homo sapiens
aggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaata

SEQ ID NO: 28974 - DNA, 540 bp, Homo sapiens
acagcgggccgggggtggcaggagaaccgccaacgcgccccgccggcccccgcgcctgccgccaccgtccacctgcccctctgagcggccgtccgacctccctgcccacccccgtgggccatcttgtctgtcggctgaccgtccgtttgtctccggaatttggcaggagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcct

SEQ ID NO: 28975 - DNA, 7157 bp, Homo sapiens
cgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttagaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaataatggggtttctgttgaaccagtctggtcaccgtcactcccattcccactccctgccttcaaattcccctaccagaggttctgggtgtgaacgtaaccatgggcaggatagcctggcagtgagagctgcatttgtacatgctttgggagatttggtacagagtgttggtgtgctaatagctgcatacatcatacgattcaagccagaatacaagattgctgaccccatctgtacatacgtattttcattacttgtggcttttacaacatttcgaatcatatgggatacagtagttataatactagaaggtgtgccaagccatttgaatgtagactatatcaaagaagccttgatgaaaatagaagatgtatattcagtcgaagatttaaatatctggtctctcacttcaggaaaatctactgccatagttcacatacagctaattcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaattttatgtattttgggaactcctgccttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaatattattctgaatggctgaagttagtcttaaactcaaattactatatgatgatttaaaacaaaataaaagagcgaggatgggggttggagtttcaggtttatgtcttcccgacatcacttttatcattcatgaaattgtcttaaaaaagcaagagactgcaaaatgtaaacagtaatcttctgtccctttaagaactgccaacaatttgtacaaaaaatgtggtacgttggttcctgcctccactccaggtcatctgtgtgtttagcctttcagggtaaactctagagggttcagtttataattcccacctttcacatatagttcaacaacattaatccagagagaattttatgttttatgatatgggttatgttttattatatattttatgttttatgatatgggttagggattctccatggactccagaaaccctaaaatacaattttgaggttttccaataataccatagcagaaatgtccaaggggttgggggaagatattactttgagaaaacagaaatgtaaaggatttttgaccttatatatgtgtgtggttttgtttttgtttttgttcttgagagagtctcactctgtcacccaggctggagtgcagtggcgtgacctctgctcactgtaacctctgcctcctgggttcaagtgattcttctgcctcagcctcccaactagctgggactacaggtacaccacacccagctcatttttttgtatttttagtagagacagggttttgccacattggcctgtctggtcttgaactcctgacctcaggtgatccgcctgccttggccttccagagtgctgggattacagcatgagccaccatgcctggcctgtatgtgtgtgttttaaagcactagatagggatggacattaaatctgtgttgcagggaaactaaacagaggtttccaaactgaaggcaacctaattgtaaatgcctgtgttaaagaggcagcttgactgttcatgtttcattttgcaaccattggttttgagattatcttttatgcacatttggagtcccttttcaacagtgacagtttcttacacgaagaatggatatggttattgggctcctctaagaatcagagtagggtaacaatgtaccaggcaaattgtaagttgaaattctagataagcatgcagatgacttacaatataaatgaagaataggaaacattttatcttcttaccaagtaccttactataagtaaacctaagataagaaaacccagatttacctataagattgttgggagttaatggtgtcaataaaaggattgatggtccctctaatgaaacccagtagatgtttgttgaattgaactgaaaatttatgtggccagacacagtggctcatgcctgtaatctcagcatttggggaggcaaaggtggaagtatccctcgaggccaagagttcatgaccagcctggtcttttgtagagaccctgtctctacaaaaatataaaaatcagccaggcgtcgtgcacacctgtagtatcagctacttgtaaggctgtggcagaagtgctttagcccaggaggttgaggctgcagtgagccatgtccacaccattgcactgcagcctgagtaacaaaatgagaccctatctcaaaaacaaaaaggaaaagaaaatatacatgatgggattcctattgtgaagtcatttaaaataatgacttgaatttctcagaaatttcaggagcatataaactatttaaatcaaaatattcttacatatagaaaccaagtaagaataaatgagagatatttcagtggacatctggacatatttatggactttgagtatctagcaagtagaaaggaaaaaaatattcatcatactctaatcatttttttatatctattgagcttgtttcttgtaaacttttctttatcttataaaggcatatctcgcttttgtatcgacctgttccttaaaaaatgtatttgataaaacaggctaaaattcatttgagtattgaaaagaattctttttttttttttaagatggtgtctcactgtcacccaggctggagtgcagtggcacagttgggctcactgcagcctctgcctcccaggctcaagtggtcctcccatctcagcctcccaagtagctggtaccacaggcatgcaccaccacacccagctaattttttgtatttttggtagacacagtgtttcaccatgttgcccaggctggtcttgaactcctgagctcaagtgatctgcccacctcggcctcccaaagtgctgggcttatgggcatgaaccactgtgcccagccaaaaagaatccttttgtaaaatacagaaacactgcaaacctttgtaaatcttttttttttttttttttttttttttttaatgagatggggtctccctatgttgcccaggctggtcttgagctcctgggctcaagaaatccttccacctcgggctcccaaagtgctgagattacagggtgtgagctaccgcacccagccatgaaaacttctgtaaatcttaactatcgtgttctgcttaaagtgaggtacacataaagtttcctgtgctttgtttttgtaggaaaaagtacatagtttgtatctttaccttacggagtctatgagatttgagaatttgatttcactttttgtaacttaacccacagaaaaggacattaacttagcagataggaccaaggactgaatgacttctgacaaaaagcgtttggtctatccttcacttgttgagctacaaccatgcattacacttctcagctgagctctcaaagagctctatgccctgtgaaaagcagtggctgagttggatgaacacatagcattattaattttgcactgggaaaacagattatgacaggaccacagaccacaatataaaaacttggcagttctttggtgtgatatattttaattagtatttgcaaataatcagagttacttgtgtacataaacgtgtgtttcacaactatggccagatgcaaccttttggtctgtttcaggaaaagacctattattccactaacaattatgctgccttagaaacataatgggagtgtaattgaagaaagcatgtctcagaaggttttgatatgcagaactggaagctattgtaattcctacatacatttccattagctatgccttatgtaatgtgagtgcagatttttacaacttagagttcccatcagtgtttttttgccacatcaccgggtttcttattttactgttttcttttcaactttgggtgctttatttccattctctaaaactaagtttcttgctcttacgagacttagtgttccttttgaacccaggtgttccacctgacagtgtttgtctttcatagactttccagaatagacatagtcaagatcagacacgtgagcttctctctcattttaatgtgaggaaaatcatctttcagagacaaggcaccgcttagaaatgtatgtccaggtatgaaagaacctttttaaaatggctggttgttccagatccagatttctctgcacactggacttcgtagagtaagtgtggtagacaaagagactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagccagttggttatttgtcataaatgaacacccatcactatatgctatgttgaggggaggcaagtctgatcttcgaataattgataaagtttaatatctttgtagccaaaatacaatttgcaaaccctaactccagatgtgtcgtatgaatcttgacaaccaggtcttgagatttgttttactgattgccaatcaggtatattatttgtgatgttcgtgggagcatgcaaattagaagacagtgttgtgggagttcctcagtattgaattacatgtgtgcactcaggcctgccagtcactgaattctgacttgtaaagggtttaacctgctgttccaatcattgaggaccaatttgctttttgataagattggaaaacatttatggagactttcccagttaaatctatgacagtgtccacttaaatagtgcaatttagtatattctcagataactgcaacacaaaattgaaatgtgccagtatgtcatctttctacctggaagatactgtatatttggaaagtttatgcttctctcaataaatacatgttattaaataagccatatcacagtttaagaaattgtatatactttatcatatgccctttcagaaaccaggtattttgcatatgattgattttagaaagattttgaagctggggtttgtccatgttaattaagatcaaagtatatatatatatatatatatgtgctgtatttgcaactttcacattgtaatttcctatacacttattaaagtattgttttgccatgtggtttattaaataaaaatgtacagtctcttaaatatctgctctttttattaagtaatattagtaggcctaaaaacattgttcttaaaagaaaatcttttataattataatgtcattttataatgccctcttatatgtttaagaaataaaactgaaaaaaatctt

SEQ ID NO: 28976 - DNA, 1317 bp, Homo sapiens
gcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaa

SEQ ID NO: 28977 - DNA, 4360 bp, Homo sapiens
gcactccagcctgggcaacaggagcgaaactccatctcaaaacaaaaaaaaaaagaatccctaacgcagaggaaaagattggtgagctttgtttaatcacacacgctgtacattttccacgccctccccctctgccctacaggaatccgctgtacttctgacggcccataggtggcactgtagggacaggtaagtgcacagggagcgccacccggagaggctgataggaggcggagcttcaatgcgacacaacgtggcgggaggagcctaagggacgaggaaaggcgagtgttctgcttgcgcagacgcaaggctgggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaa

SEQ ID NO: 28978 - DNA, 1667 bp, Homo sapiens
cacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccatgccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtat

SEQ ID NO: 28979 - DNA, 5089 bp, Homo sapiens
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttcctctctggttttaaataatctttctttattcagtagctattaataatttatctcatattcagcgaatatttattgagaatattgttgagaatctcttacatgccaggcactatactaagttaatatgcattcagtataccagttggtgtgacccagaccaaaggtaacacaaagatgaatgagaattccttcaaggcgccgataatcctagtaggagagctaagacacaaaactgttgcatgtttttaatcatcaaattaaacttctttccacgtcctta

SEQ ID NO: 28980 - DNA, 2359 bp, Homo sapiens
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagataatttaagtattttcttcttaaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagc

SEQ ID NO: 28981 - DNA, 2354 bp, Homo sapiens
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagagacggggtttcaccattttggctgggctggtctcaaactcctgacctcaagtggtccacccacctcggcctaccaaagtgctgggataacaggcgtgagctaccgtgcctgagcaatagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaa

SEQ ID NO: 28982 - DNA, 4589 bp, Homo sapiens
ggcttccggcgggagctgtgcagctccttatcatgtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttc

SEQ ID NO: 28983 - DNA, 2381 bp, Homo sapiens
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaat

SEQ ID NO: 28984 - DNA, 1770 bp, Homo sapiens
agaacggcttccggcgggagctgtgcagctccttatcatgtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggc

SEQ ID NO: 28985 - DNA, 1281 bp, Homo sapiens
gcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggtttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctggtactgtacgatccaaaacattgtacccagctttttaaaagagagaaattatcactacaactcccgagcactaagtagacggggtagagtcagccg

SEQ ID NO: 28986 - DNA, 581 bp, Homo sapiens
tgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcagaaactggaagaggaaaatgagaatctgtaaaacttgaagctgtcctcatcgggccagatggataaagcaaaatgacttttttttcttttttttttctgttagactgagcttttgtggaaagctgtaagccctcaggggaaggatatcagcttgagtaattaactcatgattatgcaaagaaaatttacctagcctctttgtttttcctttctttgttattgccttgggctacttcattttttattaccatcttctctgtttagggctaggagtaaggaaaatgacagagacaataaaaagagcccaagttttgcccattttgctttcactaacaatgttg

SEQ ID NO: 28987 - DNA, 7898 bp, Homo sapiens
gcgcggcccgggccggaagtaagcgaattcccgggtgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggtttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctgccagtaagaatttcagttgtgggcctccagtcttctggaatgtcttcactgcagctgctggaaatcactgctttcattcccacaaaaccagtattacttttttttaaaaaaagaaagaaattggaaatctgtgctatacgtaatgtcataattgttgacgttcttcagtataatcatgtttgttaaattgtttgtaccttgcaaacttatgaaccaaaccatattgggttttcaaagtgcctttgtatccaaaaatgtatttgccagcatagaaatgtaccatcaagagtcatgtatgttttatttttgtttttattttttattttttgagatggagtctcgctctgtagccaggctggagtgcagtggcataatctcagctcactgcaacctctgcttcccgggttcaagctattctcctgcctcagccttctgagtagctgcgactatgggcgtgtgccaccatgcccagctaatttttgcatttttagtagagatggggtttcaccatgttggccaggatggtcttgatctcttgacctcgtgatccgtccacctcagcctcccaaagtgctgggattacaggtgtgagccaccacgcccggctatgtttttttttttttttttttttttttttaacaatggatattctgtaaaatatcctgtacaaaacaagactattgccagtaatgtatacaaattgtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttaggctttgcacaaatacaattgctttcaggaatcctaaagcagcattttattgagtttgaattattaaaggtacagaggaaatgtggtgatgtagaacttttcctaacacaggtatctaggaagtaagtgctgagttgattttctaggttcttacgtatttgaaaaataaaattgcaattcgagataagtgcttgagcactctacttaagtattctctgtgttttatgaagagaaaatgatctgattttcccttatacttcattttacaatacatattcccttttaacttaaaaaaattgtaaatgtgggagaaaaaaccctgcaggatggaaacaattattaagaatgtagatcaataagtactttttagtgatgtggcagaaatccctgttgattctaagttttagagtgtcttttcccctatttctgacctacaactataaactactctctattaggagaactagaccactttcttcattcttttctaaactgctgcagattgccgtgaactctatcaatagtctcttttccgcaggcaaagtggcattttctaaacatgtttgcttactgccaggtggtttgaaatctatgatttactgcagtagtatgtgcttaaaacaactgttgaggtcttttaagcaggaaagttcaaaaggaagtgtcctgataatggtactggtttttctacaaatataagtagtcattagaagtttgcaaccaccaccaagtctgagagaactctgggatattctgtgggttttggcatattagatagagaaaatgacagatctagatgaagggagcttttggatgtgtgcctttaaaaactgattatgtataaatactgatatttcacatacggagatatttgaagacccaagtctgcctttcacagagccctccattccaagtttagtttttgtcaaaatatgaatcattttatttgactgtactatcagtacacaaatgcatgagtatgtttatacagtgttagactgatgtgaatttgcatttgttacattacattgccagcgcatatcatttagcaagttggcattaacatttatgctttaattaaatgccagtatacctatgtgtgcagcagtaaaaaattagtgagaaaaagcaactttttgtcactcttaggaaatattttgtcttattagtgttcttggcacatgtatattactaaagtagataattccaatgagaaatactaccagattattgttataaaattaatttacaatgtccctgatattgagctaactcttaaaaaaaccaaacaaaactcgtatctgagtgtaactttgccaatattttaaaagccaaaatattctctggacaacaaatttgtattgctcagggacagtttaccttgcctggtaaaccttcccaaacagaaatatagctatactatctttggttttgtttttttgttttttttgtttgtttgtattagatggaatttcactcttgtcgcccaggctggagtgtagtggcgcagtctcagctcactgcaacctccacctcccgggttcaagtgattctcctgtctcagctccctgagtaactggaattacaggtgcacgccaccacgcccggctaatttttgtgtttttagcagagacagggtttcaccacgttggccagggtggtcttggactcctgacctcaggtcatcctcctgcctcggcctcccaaagtgctgagactacaggtgtgagccaccgtgctcagccactagctttggttttttaaacatagattatattcctcaagatgaagggcttaacatatccacagcttcctcagtttgctaactccccatgcatctttgtgaaggacagtatctagtttatctgtaggtcagtgttccttgtgctgtcatttcccttatatctggaatttgtcagcattcctgaaaacctacacgtgtatatcagtaaccaaaatgctatgccttttttgcacctttgtacagcagccaaatcatgaactcaaaatgtatttgatcacagttctataatgtttttacctacctattatggaataatcagtttttacagagattattaatatggtagaaccctgttatgtaattccaaaacttaagaaccatatttacattgcttaacacagaattttacatctaagcaaggactggctttagaagcagtgtagttctacctctcattttacagatgagaaaaccgaagcccagaaaaactctcatttgctcaaagtcacagagaaaattagtggcaaagccaaaaagattcagatcttctgactcgaagttgagagttctttatactctattatgctgcctctccagtgtaatatttgcctttctgtaaatgggattaaatatgatttgtaaataaaggacatctgacctccttttttggtacattaaggcactttataaatggacttttattgtctcatttttcgtatataattatttccatcatattctttatggaagatgcaattaattttaacttttttactcttataaaaccagttcctgacattttaaaaaacaatatctgtaaaatggatccttttatgagtgaatttttctgctaattgcccaaggctaaatccaatttaaggattgcttagtttctttattttgtttatggtctctgaactggtatttttttataaaccaggctaattcacaggtcataccatttcattcttgtcgtgttggcttccagtcactggaaaagcttttgcattttaaagatttttagagccatgcaaaactgggcattaaatgttgcataaagcaaatcttttaagtaaggtaaaatgttgaagtcttaaccagaattcctacaactaattactaaaactgctatttctaactcttcatgaaagcattacctttggaaagttaaactttttttttcctttcatcaccgtctttgaaacaaattattttccaattcataagaactttggtaaaaaaaaaaataaaaggaaattatatgtttttctttggacattcattggaaggcttgttgaagacatgatcccccagaagccttagtgacccagatctcaaccagagactcaagatagcctcaaatacagtgaaagattatgtatccaaaaaaaaaaaaaaaaaaaaaagaaaaggagcagggaaggacagttctagttaaagccaaatggatgtgagtctgacaagggtgtctttgatttatatttcctaactgcaaattacacagaaagtgagaatggggaataacttttattaagtatttatgtgccaggcggttagtgtggccttcatgttattacatttaatcctcaaatttctacaaaggaataattttgcatgattttatgattgacggagcattttcaaatctcctctaattctcataacatctctgtgaggaaggaatttttatccttattttacagatgaggaagctgtttggagataatttaagtgacttgcctggggaatctagccagtagtagagtactgattaatcaggtgctgacatctgctctgctttgtgtatgtaattcagcagtgcttcaaagatccaagaagctgtagcagatctcaatacactctcctataaaattagtgaataatcaccatgacaaaattggtatggcggaacagtcattatacattatttagactcattccttcttccagtgcccttatgattatttcctacctttaccattgatcttaaactgtgcaggctaaaaagaggaaccagaactcccttaagcacttttaagactatttaaaaaataaagttttgttggcattgaagagtaagctgcttaagggactgaatgaaaagatagtaccctttgtggctgtatgaagagagaaactgaatttctatccaagagaccttaatttagtttattagggaattatcttccccaaaagtacaagtaattttgcactgcaggagaaggataagtagatttgatttacatcacattttatacacacctttcaaaaggaagaaatctgtttcataaatagtagtaatctatgcttaaacttaacatttaatgttgacttcttacaacagccttgaaaattatttgtaattttgatcatgatgttggaaagcttgtaataaagaatatctttctcttctgcatccttttatcctcaaacttagcatggattcacatgctgagtaaatgtttggttaactagtgaacattttagatagttgtgtcaaaaataagggttagggataggtaaaaccagtaatttactgttttttacagaagacatctcagcatttctttggcatttttgcacaaataaatgactatatattcaccttggccatttttttttttaagtagccctatgagctgctcattctttttcatatacagtggaagtatacagatgttatccattttacaaattgttggatcggaatttgacagaattgggactgtggaacctgggtcacttgaattttctatattttgtatggccaaatcaggaaccagacagtctccatagtctcctttgtttttatggaaaattgccatattcacatatttcatttatcctaatgtattgtcatccaaaatgaaagaggtctttcttgaaggtgctttaaagacatcactacatgtattcaattactgatttaaatattcccagaattattttttacctttctctttttcctctcaaacacaaaattttagtagtacctccctctatttcttcactgatttttcatctgttttcattgttatttccactatagaacttctactttatactagcggggaaaatttttttatttagaattttaatatttgaattttgtttatgtatcacatactgtgctacagttagcctcaatgaagattctattttgaactagacatcctgtcaatagtttgtcaagtaacttcattgcttcctttgatagcaattcagtgaaattttttcccaagtgatattttcccccaacttttgtgagtttgataaataggatgagtcttttatattggaaatactgtgaatggaaaattgccaaatcccttcttagtatattttaagcaccctacaacactttacctccctgcctttagtggtatttaaacatatggccaagttagtatttgggtttgattcctttggtgaagattaaggcatcaaaacatttcttaaaatgtttgagtacaaggctaagttataatgtcaactttcaaagactatgttgtgattcggtttgaatatgctgaagtgagcaattatgatttgcccaagtgcaatacaacaaatctataatgtatatttcacattttctacttgaacacattcatgtatatattttgttaaacttcatatgtatttaaaaagaatcatgaactgtatcaaaattctttcaataaaatttctatttaaaaatc

SEQ ID NO: 28988 - DNA, 5430 bp, Homo sapiens
ttttaagaagcatcaagaaagcctgcctgtctaactttggaaatatcaccctcatgctgtcttcccaggatgtctctctccctaagtaagagatgttacttcctggagggaatgcagtgttgggaatctgaagacccagctttgagctgaatttgctttgtgatacctggagagaagacgtgttttcttgacaacagcacagtacctagtgagttcaacaacaacgacaacaacagccgcagctcatcctggccgtcatggagtttcttgaaagaacgtatcttgtgaatgataaagctgccaagatgtatgctttcacactagaaagaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaacctctccacgctgtgatttttaaaactacatactttttgcaactttatggttatgagtattgtagagaacaggagataggtcttagatgatttttatgttgttgtcagactctagcaaggtactagaaacctagcaggcattaataattgttgaggcaatgactctgaggctatatctgggccttgtcattatttatcatttatatttgtatttttttctgaaatttgagggccaagaaaacattgactttgactgaggaggtcacatctgtgccatctctgcaaatcaatcagcaccactgaaataactacttagcattctgctgagctttccctgctcagtagagacaaatatactcatcccccacctcagtgagcttgtttaggcaaccaggattagagctgctcaggttcccaacgtctcctgccacatcgggttctcaaaatggaaagaatggtttatgccaaatcacttttcctgtctgaaggaccactgaatggttttgtttttccatattttgcataggacgccctaaagactaggtgacttggcaaacacacaagtgttagtataattctttgcttctgcttctttttgaaaatcatgtttagatttgattttaagtcagaaattcactgaatgtcaggtaatcattatggagggagatttgtgtgtcaaccaaagtaattgtcccatggccccagggtatttctgttgtttccctgaaattctgcttttttagtcagctagattgaaaactctgaacagtagatgtttatatggcaaaatgcaagacaatctacaagggagattttaaggattttgagatgaaaaaacagatgctactcaggggctttatgaaccatccatcaattctgaagttctgactctcccattaccctttccctggtgtggtcagaactccaggtcactggaagttagtggaatcatgtagttgaattctttacttcaagacattgtattctctccagctatcaaaacattaatgatcttttatgtcttttttttgttattgttatactttaagttctggggtacatgtgcggaacatgtaggtttgttacataggtatacatgtgccatggtggtttgctgcactcatcaacctgtcatctacattcttttatgtctgtctttcaaagcaacactctgttcttctgagtagtgaaatcaggtcaactttaccaccagcctccatttttaatatgcttcaccatcatccagcacctacttaagatttatctagggctctgtggtgatgttaggacccataaaagaaatttatgccttccatatgtttggttacagatgggaaatgggaatgttgaaggacatgaaagaaaggatgtttacacattaagcatcagttctgaagctagattgtctgagtttgaatcttagctcttccctttattagctctgtgacctcgagctagttacttaaatgctctgatcctctatttcctgatcagtgaaacctccctattcaaatgtgtgagagtttaataaattaggacacttaaaaatgttggagcagtgcatagcatgtagtgttcagtacatgttaaatgttgttttttattatgtacaaacatgagtgggcacagaattttaaatcatctcaacttttgagaaattttgagttatcaacaccgttcccacaagacagtggcaaaattattggtgagaattaaacagctgtttctcagaggaagcaatggaggcttgctgggataaaggcatttactgagaggctgttacctagtgagagtgatgaattaattaaaatagtcgaatccctttctgactgtctctgaaagcttccgcttttatctttgaagagcagaattgtcactccaaggacatttattaataaaaagaacaactgtccagtgcaatgaaggcaaagtcataggtctcccaagtcttaccccattcctgtgaaatatcaagttcttggcttttctctgtcatgtagcctcaactttctctgaccgggtgcatttctttctctggtttctaaattgccagtggcaaatttggatcacttacttaatatctgttaaattttgtgacccaacaaagtcttttagcactgtggtgtcaaaaagaaaaacacctcccaggcatatacattttatagattcctggagaatgttgctctccagctccatccccacccaatgaaatatgatccagagagtcttgcaaagagacaagcctcattttccacaattagctctaaagtgcctccaggaaatgattttctcagctcatctctctgtattccctgttttggatcacagggcaatctgtttaaatgactaattacagaaatcattaaaggcaccaagcaaatgtcatctctgaatacacacatcccaagctttacaaatcctgcctggcttgacagtgatgaggccacttaacagtccagcgcaggcggatgttaaaaaaaataaaaaggtgaccatctgcggtttagttttttaactttctgatttcacacttaacgtctgtcattctgttactgggcacctgtttaaattctattttaaaatgttaatgtgtgttgtttaaaataaaatcaagaaagagaga

SEQ ID NO: 28989 - DNA, 2520 bp, Homo sapiens
atggagtttcttgaaagaacgtatcttgtgaatgataaagctgccaagatgtatgctttcacactagaaagtgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaa

SEQ ID NO: 28990 - DNA, 1915 bp, Homo sapiens
ctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctggg

SEQ ID NO: 28991 - DNA, 898 bp, Homo sapiens
cttcaatgttcttaactatgtcatcttcttggactgctgttactgcgcagcacccaagccccagggagacatggaagcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaa

SEQ ID NO: 28992 - DNA, 883 bp, Homo sapiens
actgcccccgccactcctttagactctggacgtgcggggactggtggcgctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcagaacttatacacaacacaaggtttcttctttga

SEQ ID NO: 28993 - DNA, 1224 bp, Homo sapiens
gccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacatgctgggattacaggcatgagccaccacacctgtccctctccccctcgtattactcagacttaaactaccccaaaaaggctaaagtcctgctaagagtctccgtagaactgatgattcaagaggctcttatgatcacagctggtgattccctgtgttgaattagtgaaaacaggccaggcacagtaatcccagcactttgagaggactgcttaatgtcaggagctcaagcccagcttgggcaacacagatgcctgtctctacataaaacaataaaaatttttaaaaaaaatttttttttaatgcccagaacaatagggcatgattcaaaattatcctccgagctgcctctctggttctttctgggaaaaacacttaggcaagttgagaaaggaaggaaagttggaataatggcaaaactgttagaagcattcctctttcctccattgcctgtcctcccaacattatacccaaactagttacaaagccattctgtaaagagatcgggtacctacaatttcttcagatttacacaatatccactagaatttaatttctacaagggcagggatctttgttgagtggcacatggtagacactcaataaatacttattgaatagatgggttaagtgaaagtggcagggatcaactagagtgtcctgtgcttagggtcttttaataaagatggaaagaatgatgttaa

SEQ ID NO: 28994 - DNA, 4744 bp, Homo sapiens
gcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaacactttgggaggccaaggtgggaggatggcttgtgtccagaagttcgagaccagcctggacaacatagtgagatcctatctctataaaaaatcaaaaattagccaggcatggtggtgcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcaaggccagttaagacaaaatgctatgactttgaaattcacagaaagaaataacagtttagattaggtcttcaggtattcaggatagagataatctcctgaaaaacctgaatttcagagattcttagactggctgccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaattaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattcta

SEQ ID NO: 28995 - DNA, 1785 bp, Homo sapiens
ctcgcccggaccacgtgatccgtgcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaata

SEQ ID NO: 28996 - DNA, 2404 bp, Homo sapiens
atatgctttttctggagtcctgtagagaaagtgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaa

SEQ ID NO: 28997 - DNA, 3725 bp, Homo sapiens
gcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 28998 - DNA, 2573 bp, Homo sapiens
cttcattgagctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacaggctcccacctccatgtccagagcagaggccaactccagccagacccttggaaatgccaccatggagaaatgcaaccacatctttgtggacactggcctaccggacctggctgtggggctcatcctgctggcaggatccctggtgctgctgtgcacctgcctcatcctcctagtcaagatgctcaactccctgctcaagggccaagtggccaaggtcatccagaaggtcatcaatacggacttccctgcccccttcacctgggtcacaggctactttgccatggtggtgggcgccagcatgaccttcgtggtccagagcagttctgtgttcacctcggccatcaccccactcatcggtcttggtgtgatcagcattgagagggcctacccgctcacactgggttccaacatcggcaccaccaccacggccatcctggctgccctggccagccccagggagaagctgtccagcgctttccagattgccctctgtcacttcttcttcaacatctcgggtatccttctgtggtacccggtgccctgcacacgcctgcccatccgcatggccaaggcgctggggaaacgcacggccaagtaccgctggtttgccgtcctctatctccttgtctgcttcctgctgctgccctcactggtgtttggcatctccatggcaggctggcaggtcatggtaggtgtgggcacgcccttcggggccctgctggccttcgtggtgctcatcaatgtcctgcagagtcggagtcccgggcacctgcccaagtggttacagacatgggacttcctgcctcgctggatgcactccctgaagcccctggaccacctcatcacccgcgccaccctatgctgtgccaggcctgagccccgctcacccccgctgccccccagggtcttcctggaggagctaccccctgccacaccctccccccgtcttgcactgcctgctcaccacaatgccacccgcctctaggctgtgggcccagactacagcctggaatggggaaggcctggggtggaaaggcaggggagggagggtgtgtgtaggtatgtgcatgtgcctgtgccaccctgggtgccagtctctccttctgtagctccgcaaagctctgggcttgtgtgagagtgtcggtgtgtgtgcatgtgtgggggtgagtctgcatgtgcacctgtcatgtgtagaagcttgtatttgtgtacaggtgtgccagcccatgcaggtgtacacagacacacctgtgggaggctgtgtgcaggctgcaggatatctgggtatgatttcaggtcctctgcacgtgtacacatgactaggataggcaggagtaagggtgggtctgggtatatgactgtgcagctgtttgtgcatagatgttggtgcctgcgttactgaatttgcacacctccttgccaccttccttcctccaagataccatctcctcatcctaacccaggtcttcggcaccaccacaattaattcccttcccaacacttgcctgatggaaaaaaaacaaaggaattaaaactctcctcaggca

SEQ ID NO: 28999 - DNA, 532 bp, Homo sapiens
atctggaaaatagaacttggaagagacgatgtttcagggccttgcctgctctgtgctggggccaggcagctctgttgaagtccaggctctccaagagaggacaaagtcaaggaggccaggaaagccattgctttgttacccaaagggaacccaccgcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcacctt

SEQ ID NO: 29000 - DNA, 1912 bp, Homo sapiens
gtcctggaggcttcattgagctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacagcaaaatctggaagggagagaaatcacacactttgatcttcgcaaaaagcaagccatggaagacagctctgttcctcactgcccctgagctccctgccggccacctactgcagcttccggcagatctcaaccagcagcctccacgtcctcacttgaagtcatcctcacccaggttcactctggggaggccgcccttgggcctttctctacggctgcagctgacacttgtccagctggtttctcttcctcactctaccaggaaatgctttccttaaacgctttctgcagggcagggtctcatttcctcggcttggagagtagctggtgggtgggacccaagctctcactttcatcccctttctgggacagcgccccgaaggagtgtgactcacacagcagtggatgtgcttggtcttgcaaagtgtgaagtgcgtcctggctcttcctgcccaaagacgggccacagagtctccccgtgctcccttccaacctgttcccattgacgccaactttcaccatgctggacctgaaccagcccgaaacagtctccagggaagctatgcaccagggagaggaggcaagtccaaggcctaccagatggggaaagcagcagcagcggcagttgagtgatcagacacttgagtctcccgggaccctgacaccgtcctgggaatcaccttcttatgtggccacactgtggactgtcaactatacctgcctggattaaacaagcatcttttgaggacttgcaacctgggaggcagggattatcacgtccccattttacagacgaggagcactgagccccagagaagtgcagtggcttgcccaagtccatgtaattgaggtaggatacaaatcctggtagaatcctga

SEQ ID NO: 29001 - DNA, 4122 bp, Homo sapiens
tccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaa

SEQ ID NO: 29002 - DNA, 2174 bp, Homo sapiens
agtttgtttctattagggcccgtggccatcagcgaagggtccgtccttcagccgtcttggggagcaaagcccgcaatttatgttttccaagccacaaatggaccatggctccctggcctgaattgggagatgcccagcccaaccccgataagtacctcgaaggggccgcaggtcagcagcccactgcccctgataaaagcaaagagaccaacaaaaataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtag

SEQ ID NO: 29003 - DNA, 2162 bp, Homo sapiens
atatatacccggggcgctgcgctccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaaataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcag

SEQ ID NO: 29004 - DNA, 582 bp, Homo sapiens
gtttctattagggcccgtggccatcagcgaagggtccgtccttcagccgtcttggggagcaaagcccgcaatttatgttttccaagccacaaatggaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagc

SEQ ID NO: 29005 - DNA, 549 bp, Homo sapiens
attgcggacctagagcccagactcccagggcagaaagcgccccacagactgataaagaccatggctccctggcctgaattgggagatgcccagcccaaccccgataagtacctcgaaggggccgcaggtcagcagcccactgcccctgataaaagcaaagagaccaacaaaaataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacg

SEQ ID NO: 29006 - DNA, 2124 bp, Homo sapiens
acacaggtaggagctcctaggaccaggctgaggcccagggacagtgaggccgaggctgggtggcctccaggccaagggcttgggccccatcctgagtctccaggacccaagggcaagagacgccaggcttgggcagcaggagggaggatctagacctgggcctgggtctgtccctgcccgaaatccatgccgagttcccttcccggcagccaggtcccccaccccactctggacgcggttgacctagtggaaaagactctgaggaatgaagggacctccagttctgctccagtcttggaggaaggggacacagacccctggaccctccctcagctgaaggacacaagccagccctggaaagagctccgcgtggccggcaggctgcgccgcgtggccggcagcgtcctcaaggcctgcgggctcctcggcagcctgtacttcttcatctgctctctggacgtcctcagctccgccttccagctgctgggcagcaaagtggccggagacatcttcaaggacaacgtggtgctgtccaaccctgtggctggactggtcattggcgtgctggtcacagccctggtgcagagttccagcacgtcctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctgtgctgcgcggccgcgtggcccaggtcgtgaggacagtcatcaatgcggacttccccttcccgctgggctggctcggcggctacctggccgtcctcgcgggcgccggcctgaccttcgcactgcagagcagcagcgtcttcacggcggccgtcgtgcccctcatgggggtcggggtgatcagtctggaccgggcgtaccccctcttactgggctccaacatcggcaccactaccacagccctgctggctgccctggccagccccgcagacaggatgctcagcgccctgcaggtcgccctcatccacttcttcttcaacctggccggcatcctgctgtggtacctggtgcctgcactgcggctgcccatcccgctggccaggcacttcggggtggtgaccgcccgttaccgctgggtggctggggtctacctgctgctcggattcctgctgctgcccctggcggccttcgggctctccctggcagggggcatggagctggccgctgtcgggggtcccctggtggggctggtgctcctcgtcatcctggttactgtcctgcagcggcgccggccggcctggctgcctgtccgcctgcgctcctgggcctggctccccgtctggctccattctctggagccctgggaccgcctggtgacccgctgctgcccctgcaacgtctgcagccccccgaaggccaccaccaaagaggcctactgctacgagaaccctgagatcttggcctcccagcagttgtgacgggcagttgctgagcagaccgccccaccctccccggctgggagggctctggagggccctggagggggggtccccgcggcagctgacctccggtcacctgcttccccttctgtgcaaataaaccaggctgttatctgg

SEQ ID NO: 29007 - DNA, 2162 bp, Homo sapiens
atggagacaaggcctaggggccttggggccaggagggtacccccgtgagggcctgggctcctgggtaaacattaatgggctcagtacccagcaggtcatgtgcgcgatcaggggatctttgacctgcaactgctcccgccccgtgtctcctccctgcaggtgccccctcaccacccacacagcagatctagacctgggcctgggtctgtccctgcccgaaatccatgccgagttcccttcccggcagccaggtcccccaccccactctggacgcggttgacctagtggaaaagactctgaggaatgaagggacctccagttctgctccagtcttggaggaaggggacacagacccctggaccctccctcagctgaaggacacaagccagccctggaaagagctccgcgtggccggcaggctgcgccgcgtggccggcagcgtcctcaaggcctgcgggctcctcggcagcctgtacttcttcatctgctctctggacgtcctcagctccgccttccagctgctgggcagcaaagtggccggagacatcttcaaggacaacgtggtgctgtccaaccctgtggctggactggtcattggcgtgctggtcacagccctggtgcagagttccagcacgtcctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctgtgctgcgcggccgcgtggcccaggtcgtgaggacagtcatcaatgcggacttccccttcccgctgggctggctcggcggctacctggccgtcctcgcgggcgccggcctgaccttcgcactgcagagcagcagcgtcttcacggcggccgtcgtgcccctcatgggggtcggggtgatcagtctggaccgggcgtaccccctcttactgggctccaacatcggcaccactaccacagccctgctggctgccctggccagccccgcagacaggatgctcagcgccctgcaggtcgccctcatccacttcttcttcaacctggccggcatcctgctgtggtacctggtgcctgcactgcggctgcccatcccgctggccaggcacttcggggtggtgaccgcccgttaccgctgggtggctggggtctacctgctgctcggattcctgctgctgcccctggcggccttcgggctctccctggcagggggcatggagctggccgctgtcgggggtcccctggtggggctggtgctcctcgtcatcctggttactgtcctgcagcggcgccggccggcctggctgcctgtccgcctgcgctcctgggcctggctccccgtctggctccattctctggagccctgggaccgcctggtgacccgctgctgcccctgcaacgtctgcagccccccgaaggccaccaccaaagaggcctactgctacgagaaccctgagatcttggcctcccagcagttgtgacgggcagttgctgagcagaccgccccaccctccccggctgggagggctctggagggccctggagggggggtccccgcggcagctgacctccggtcacctgcttccccttctgtgcaaataaaccaggctgttatctgg

SEQ ID NO: 29008 - DNA, 1206 bp, Homo sapiens
acaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggagtatattttgaaaaagtttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatg

SEQ ID NO: 29009 - DNA, 1851 bp, Homo sapiens
agttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaagaaa

SEQ ID NO: 29010 - DNA, 1720 bp, Homo sapiens
acaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcagttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgt

SEQ ID NO: 29011 - DNA, 770 bp, Homo sapiens
atggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtgttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtga

SEQ ID NO: 29012 - DNA, 924 bp, Homo sapiens
agttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagaaaaaggatttttctatggttacacatattatgtctggtttgtcatctgtaagtatccaggaattaaaggttcttagtagatcctttattttttttttaagttagatgtccattttaagctgttataacattttgaaattaatcctttgatactgtaaataccagtttgaatataattttcattttgttgacttagttttgattgtgaaggcaaaattgctttgggatagcaatgccccaaaatatctaacattagcaaaaaatgtgtaaaatttaatagaccacatagccctctgggcattgttttggaaaaacagtgttatataggaactaccaattttagtacaaactctcagatggctccttctaaggaaaacagtattttccttttcctaggtaaagtatggcatctctggggatgaaaattgcctcaccattatgtaatgtttcatttatttgagtgat

SEQ ID NO: 29013 - DNA, 1207 bp, Homo sapiens
gtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaac

SEQ ID NO: 29014 - DNA, 1451 bp, Homo sapiens
caacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgcc

SEQ ID NO: 29015 - DNA, 655 bp, Homo sapiens
gttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcattgagatgc

SEQ ID NO: 29016 - DNA, 1000 bp, Homo sapiens
atcgggggatgatctggaaagcgcgatcagtgaagcggacgaacggcaggataaggcgggtctagtgacaggaatgggccgatgaagctctgtagggatgctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaa

SEQ ID NO: 29017 - DNA, 2619 bp, Homo sapiens
atcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttag

SEQ ID NO: 29018 - DNA, 778 bp, Homo sapiens
atggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcag

SEQ ID NO: 29019 - DNA, 1424 bp, Homo sapiens
agatgccaacatggcagcggttggggctggtggttccaccgcggcgcccgggccaggggcggtttccgcgggtgcattggagccggggaccgccagtgcgggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttca

SEQ ID NO: 29020 - DNA, 1726 bp, Homo sapiens
cgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttattta

SEQ ID NO: 29021 - DNA, 877 bp, Homo sapiens
cgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggt

SEQ ID NO: 29022 - DNA, 1563 bp, Homo sapiens
agatgccaacatggcagcggttggggctggtggttccaccgcggcgcccgggccaggggcggtttccgcgggtgcattggagccggggaccgccagtgcggagttgcttctcacttgggaggaagccgaggcgcgtggccagggtttgcctcagccattacctgacacctcagtaaggattccagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaagg

SEQ ID NO: 29023 - DNA, 6162 bp, Homo sapiens
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaacccatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttaaaaaaaaaaaaaaaaaagaaagaaggtcttgctctgtcgccagccaggctggagtgtaatggcgtaatcatagcagctcaccacagtctcaaactcctaggctcaagtgatcctcctgccttagcctgctaagtagctacgactataggcatgtgccattacgcctggctcgtttcttcctttttttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctgaaaacaagtattaaaattcctttgtaactgcatacagagactaatccaga

SEQ ID NO: 29024 - DNA, 1748 bp, Homo sapiens
ttcacggagctaagttaggtttgttctgatcttgtttttttctttgccctttttgtagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagctgtatctgccacagaggtctctgtgagttaagagttggtagtgccactttgggaggctgaggcgggcagatcacaaggtcaagagatcaagaccaccctggccaacatggtgataccccgtctctactaaaaatacaaaaattagctggatgtggtggcaggcacctgtagtcccagctgctcgggaggctgaggcaggagaatcgcttgaacccaggaggcggaggttgcagtgatccgagattgcgccgctgcactccagcctggcaacagagtgagactccgtcccaacaaaataaaacagttggtagtgctgttgtttgaagattagacagatggaaaattgcttgaaaattttttaaaaggcataaacttaggcttgcataatgactgtaccttattttcaatatgcatgttttaactttttaaaagaaaatcttgttgaccagtactaataccaggagttctacttttaaaaaatgaatatttaggatgatctaatgtattaacaccaatttcatagtactagaaggtatcaactttaatgtgaatatttatggggccaatagattagttaaagggtctctgtttgaagtagtagaagatcctgatttagaatcatttggtagtgttgtataaaaagtcagatataacccctctccccttcaaatctgggcttttcctcattttccctttcccttccttctagttttccccttccccaaagctgctagagagcaaattatagttcctttccaaagcgtttactcatcactgcgtaacacatagtatgctcgttgatgaatattcagttctcttcaggtggttcatgaattgccctttccgaaaatctatatttgataatgatcgagtcagtaataaagatgaaattaaatatattttattgttgcctcaagttacaaccatgtggca

SEQ ID NO: 29025 - DNA, 2078 bp, Homo sapiens
atgagctctcgctcggtgttgagccctgtggtaggcacagatgcacccgaccagcacctggagctcaagaagccgcaggaacttaaagaaatggaaaggctgcccttggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactc

SEQ ID NO: 29026 - DNA, 2347 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcatt

SEQ ID NO: 29027 - DNA, 748 bp, Homo sapiens
ttgaaaagattttattctgaaagactcttgccttctcaggcctttggttagagaaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacat

SEQ ID NO: 29028 - DNA, 1759 bp, Homo sapiens
cgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggagggtctcactgtcaccttggctggagtacagaggcgcaatctcagctcactgcaacttccacctccctggctcaagtgatctcccaccttagcctcccaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacattt

SEQ ID NO: 29029 - DNA, 5533 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttgtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggagaggtagccaaattttgaattccctttctgtgttcccacaagagctgctgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaaaagctactgagaaggagccaccattttgctttaaaatagtgggtttttttcctttttaatgaacactggagctgaggatgcagattacatgagttatttaataagttgattcaagagagagagagtatattagaaatggtaagatgatttggtgggcaaaaatgctttctataatttgaatatgggtttaatttaattattaactatagacagaattacttactgagtataagaagtattttactgtctgggcacagtggctcatgcctgtaatcccagcactttgggaggccgaggcgggtggatcacaaggtcaggaattcgagaccagcctggccagcatggtgaaatcccatctctactaataatacaaaaattagctgggcatggtggtgcgcgcctgtagtcccagctactcaggaggctgaggcaggagaatttcttgaacacaccaggtggaagttgcagtgagccaagatcgtgccactgcaccccagcctgggtgacagagcgagactccgtctcaaaaaaaaaaaaaagaaaacacacacacacacacacacacccacagtatgaatgaaaaaaataaaatacttctttttttttttttttgagacagagtctcactttgtcgccaggctggagtgctgtggcgcgatctcggcttactgcaacctcccactccctggttcaagggattctcctgcctcagcctctgagtagctgggattgcaggcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaa

SEQ ID NO: 29030 - DNA, 563 bp, Homo sapiens
agtgtgtgcctcagcgcctggtgcgtgcggagctagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttgggtctcactgtcaccttggctggagtacagaggcgcaatctcagctcactgcaacttccacctccctggctcaagtgatctcccaccttagcctcccaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacact

SEQ ID NO: 29031 - DNA, 5218 bp, Homo sapiens
aagcgaatgaagacggcagtgtgtgcctcagcgcctggtgcgtgcggagctagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggagaggtagccaaattttgaattccctttctgtgttcccacaagagctgctgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaaaagctactgagaaggagccaccattttgctttaaaatagtgggtttttttcctttttaatgaacactggagctgaggatgcagattacatgagttatttaataagttgattcaagagagagagagtatattagaaatggtaagatgatttggtgggcaaaaatgctttctataatttgaatatgggtttaatttaattattaactatagacagaattacttactgagtataagaagtattttactgcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaacttctcttgtcattttttggtatccagctattacctatttaatagatttattgaaatagattattttcataaagaactctatacaaa

SEQ ID NO: 29032 - DNA, 1606 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 29033 - DNA, 1150 bp, Homo sapiens
cctcagagttgcctgattggaaaaatctccagggcgagggatcagtctcgaggctgccggttcccctggccctcagggatggagccaaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaa

SEQ ID NO: 29034 - DNA, 1587 bp, Homo sapiens
agctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcatt

SEQ ID NO: 29035 - DNA, 910 bp, Homo sapiens
gatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggtgagagccagttctgctgttcttcccatgtatcaccagagggcaggctgccctcatccttttgatccctctagctgttagttgcccagaccaagggcctgaattagttccaagatgcccttttgttcaagcccttgagaaaccttcctggaaaaacctgcaccagca

SEQ ID NO: 29036 - DNA, 1477 bp, Homo sapiens
gtcctcagagttgcctgattggaaaaatctccagggcgagggatcagtctcgaggctgccggttcccctggccctcagggatggagccaaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatca

SEQ ID NO: 29037 - DNA, 2424 bp, Homo sapiens
ctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccaggtaagcaaagaagatggtcttcctcttctgtcgtcactcttcctatagtaagctctctctctgctacaactgtgtccctctcggcttcatcatcccatcatggctgtctccagggactttcccccagctctccctgctgcccatcctgtcatctgtgtcacttcttgtgatgttcataggctggtaatccttaataggagctaaaggctgacctagcctgcttcacttggtcagccatttctgtgttgcatgtgtttatattgtcattagacaacttaattcccattttgatcatcagtttctttatctcaacttcttttccttctccactgttccctacccttgtcctgtcccttcctggacttttcacctttgttctctacctcctccctgtcttatacttaaccctgttgctcaatccttatctaggtgccagcctggcaccctccttttgtcctctctaagccttccttctcagtcattcttttctccctgagtcttttcttggttcctgggagggagggcattggggtcatcaataccttatggatgcctgaattttccactctgttttttccctgtagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctggcgatggggtcttgctgtgttgcctaggctggccttaaactcctgggctcaaatgatcctcctgcctcagtctcccaaaatgctgggattgcaggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaag

SEQ ID NO: 29038 - DNA, 1315 bp, Homo sapiens
aggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttga

SEQ ID NO: 29039 - DNA, 2043 bp, Homo sapiens
ggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgca

SEQ ID NO: 29040 - DNA, 1434 bp, Homo sapiens
agagcgcggcacttccgctggccgctggctcgctggccgctcctggaggcggcggcgggagcgcagggggcgcgcggcccggggactcgcattccccggttccccctccaccccacgcggcctggaccatggacgccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgc

SEQ ID NO: 29041 - DNA, 1498 bp, Homo sapiens
acttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtga

SEQ ID NO: 29042 - DNA, 1018 bp, Homo sapiens
gcacgcgcgcagggacacataggcggaagtggcctgcgggcgccggagttgagagtgctttccggggaggcgaccgccgcggtggaaagtgcaggagtgggcgaggaggaggaggaagaggaggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatgaatattactaccagtagttattctggggtgtttatattcccaaataaactaaaaatcccattggtattgtga

SEQ ID NO: 29043 - DNA, 2137 bp, Homo sapiens
gcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaa

SEQ ID NO: 29044 - DNA, 1351 bp, Homo sapiens
ataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggaggtatgtggtttgtttttattttttgatatttctatattagttgaatttttttggcatactgaatatgcatgaaatttatacttctattaacaaaacatgtgataggcacgaactcttagtgtaactaacttaatactaaatacattttattcatttatacactgaaaaaaataaagtcttaaatgcagtattacaaaataaaaaaatattagctttaggctcaacttagtgttatatgttcttacaacatgataaaaaacacaatgtacatacttgatttgtataaattctgctgaaataggtgcagttactgatttgtagtacaactaacatcacagtggtgaaatgaaatatcagtacaggttgagcatcctaatccaaaaatcctaaatccagaaatgctccaaaattagaaaagttttgagtgccaatgtgacacaagtggaaacttccaaacataagtacttaacacaaattttgttttgtgcacaaaatgatataaaatgtgcaccatgaccagctctgggacagctgggatgcagggcaccaagttcttaagctgcacacagcatagtgaccttgggtgcagcccacaaaacc

SEQ ID NO: 29045 - DNA, 6797 bp, Homo sapiens
cggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggcttactatccatggtcttggaaaagattgtcccttctcttgctgttgtaatgcatctctgctacagcagtcattgtcatcctgtgaccttatcccttttgtctcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaaaaaagaaaggttgttatggactggacacccctgaagcccattgcctaggccacagtggtgacggcaggatggccctgctcagcaccgcaagagccatggctgtccctgttggcccagccgggcactcacagggcagaagggtgggtctcaagtgggaggataaggcttcaccaccaggagattcccctctgcccgatgactctgttaagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaaacatgcctctctttgctaatcatttcagaggtccagttttcctttcactggacaatcttgaataggaggaacgctgttgctgtaatatgcgtagcttctgtgtgctcttgtgtagtctgtgtgtgatcaaagggcacggaagtggctgcactttcacatcccttttctttacttagctggaaccttacataccagtacatgctcctctgtaagcagctgaactcaccggccacttctctgtttgcctatagacaaagactgtgtgtgtgtgtgtgtatgtatgtgtgtgtgtgtggtgcacacattgtgttcttaaactgagacgtggctctgcaggtctcctgggctcattccatggtgtggtatgtttattccactgtccagagctattctctgatggatttgagcaacagcagtggagataaatgtcctagagtcaccaggtcgcttggagaagtcatttaagctgcctcgggtttttgttacttaaaatgtggatattatttctccacctaaatcactgagtttacagagtaataatgtgttgctctggacattgacagctttctagagccagtaatgggctcttctgaaggatgctgaattagaagtgaacctattcataggatcaaaagccacttgctttgaaatatgtagagttcctcagaattgacggtgctagaaatatccaagtgttaaataaccttttaaaagcaacaaaagctacttttttcttaccacttaatagaagaacctgtccctagaggcgacttcattgctatggatctggagtctctgaactcttaataggatgcagcctcacatacataatgtcacccattttatgttgatgaaaacattacaagttttcttcattgggtatgtgttgatgttcacagacagtacttgggcccattaggttttcgcgtctggtcttagagcatgtgtattcatctcagcgtgaatacctcagccagtcttatgaataggaggctatgtatgggcagggaatagattagattagaacactcgcacaagatgaccacatatagaagcagaaagccccaaattccctgggaactgttttttctctagtagctgaatataaggaaatatgtctaatggacaccagttaatactttttaaaactactctttaaaaaaaaaatacgttccccttggttaactgattttttaatccagggtggacattttttcaacctttattaaaaagacaaataaactattttgtagaagatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcagaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacattcataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatcacttgcgattgccagtcatttctgtgccagttgctttcattccagagaatggcctcattctccaaaaaaagatgatgattttagaagtaggatttcctaacaaattatgtggtggggagggacggcggggattttattcatcccgtctgagctcttcatacagtattaccattaggttttaagaacaaagatgggggaggagggagtagaaagctgagagtacgtagaacagctacaagacattagtgggtattcagattttgagctgtgtaaatatcaaacatcggcttccagccttaagagttatttgagcagagagttaaggaggaatgggagattttgtgaataaaatgttttgccaaactgaa

SEQ ID NO: 29046 - DNA, 4171 bp, Homo sapiens
agtgcaccggaggaggtgagcgccaggtcgccttcgcggcccggggacacaggcagggacgcgggagctgatgcggctggaccggccggggaaacagtattttctggaaggggtaagagatgctgtcttgagcctttggaatctcggatccgggccgcccagaggacctcgacaggagcacagggaggacaaactgaagtccgagagaggcggcgtggcctccggcctcggggagcgctgccgggggtctcgggcttgggagagggcctgggggcggtgaaaatggggggaaaggaggggaccacaacattgttatggaagagtgagctcggattggcagagggacgcggggctgcaacgcgagtctccggaggtggaggggtccaggctgatgtagcgccgcccgggtcctgggtcggggttccgggaagtggacctgcgagccaagcctagccaagtcgggggacggaggctccggggcggacggagctgagggtgggcaggcgaggttgatggagcccttccaggaagcagggcgaggctcaagcacccagaaaaacctgtggctgccgaggtcccccgccagcagcgggcagcggagcgcaggggcggggctggggactggcgaactccgcctctctggggctgtcgctttaagggcaaggcggggcgtgcgggccctttaaggccacgtgggggcgtgtcaggaagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgcccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataag

SEQ ID NO: 29047 - DNA, 1756 bp, Homo sapiens
tccccgcacgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgcc

SEQ ID NO: 29048 - DNA, 3111 bp, Homo sapiens
tccccgcacgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgcccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatcc

SEQ ID NO: 29049 - DNA, 582 bp, Homo sapiens
tctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacg

SEQ ID NO: 29050 - DNA, 695 bp, Homo sapiens
ctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcg

SEQ ID NO: 29051 - DNA, 1787 bp, Homo sapiens
ctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgccccttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataag

SEQ ID NO: 29052 - DNA, 1613 bp, Homo sapiens
ggccgggcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgta

SEQ ID NO: 29053 - DNA, 889 bp, Homo sapiens
gtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtaagactttggactgtttctgctcaataacttctttgtgtctttgacaataggcccagccccatcctcagtttttcattttccatctggctgctgttgaattgagcaggcaagagacaaatctgttgaagttagtggaatccccatgtgttcctatgaaagtcaaagtgggtcccacattggccagaaaatttctgagaatatatgaagagagcattgcaagatattaatatagcttttcttcacaaaaagcagtgaactgtttacatttcttactgaatgtttgtcttcattataacaactttacttgagaagttcttaggcatttgattaataataacagacttacaaag

SEQ ID NO: 29054 - DNA, 1361 bp, Homo sapiens
tcttccccggcccggccgggcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgt

SEQ ID NO: 29055 - DNA, 2359 bp, Homo sapiens
cgcaagaacgcctggccggagctgccctctgcagccgagccggcgccccctgcccttcgccgccgcgctgggcgggcgcccccgccgccctcactccgctgctcccggctcctcgcgcgcaggtcgcggagctccgccaccgctgggtgcggcgaggccggcgcgatgcggcagctgtgccggggccgcgtgctgggcatctcggtggccatcgcgcacggggtcttctcgggctccctcaacatcttgctcaagttcctcatcagccgctaccagttctccttcctgaccctggtgcagtgcctgaccagctccaccgcggcgctgagcctggagctgctgcggcgcctcgggctcatcgccgtgccccccttcggtctgagcctggcgcgctccttcgcgggggtcgcggtgctctccacgctgcagtccagcctcacgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggagccggcgacctgacgggcgaccccatcgggtacgtcacgggagtgctggcggtgctggtgcacgctgcctacctggtgctcatccagaaggccagcgcagacaccgagcacgggccgctcaccgcgcagtacgtcatcgccgtctctgccaccccgctgctggtcatctgctccttcgccagcaccgactccatccacgcctggaccttcccgggctggaaggacccggccatggtctgcatcttcgtggcctgcatcctgatcggctgcgccatgaacttcaccacgctgcactgcacctacatcaattcggccgtgaccaccagcttcgtgggtgtggtgaagagcatcgccaccatcacggtgggcatggtggccttcagcgacgtggagcccacctctctgttcattgccggcgtggtggtgaacaccctgggctctatcatttactgtgtggccaagttcatggagaccagaaagcaaagcaactacgaggacctggaggcccagcctcggggagaggaggcgcagctaagtggagaccagctgccgttcgtgatggaggagctgcccggggagggaggaaatggccggtcagaaggtggggaggcagcaggtggccccgctcaggagagcaggcaagaggtcaggggcagcccccgaggagtcccgctggtggctgggagctctgaagaagggagcaggaggtcgttaaaagatgcttacctcgaggtatggaggttggttaggggaaccaggtatatgaagaaggattatttgatagaaaacgaggagttacccagtccttgagaaggaggtgcatgtacgtacctatgtgcatacacttattttatatgttagaaatgacgtgttttaatgagaggcctccccgttttattctttgaggagtggggaagggaagaaaagaaagaagctgaaaggtactgacacagagcaacaaaattagcacctgtgtgaattatttagtgtgacttcacctgaggcatcacagagacaaaagaatgtgaagctacttaacaaagtaaggcaacgtttctgcttcagactcctggcacatttactttttgtcattataaccataactaaatatctgcatgtaccaagagtccctaagccaccccctccaaagatggagtgtagaaatgatgacagcacttagtaagttcaaagatgacattcagggatgcattttttgatgatagaactacagtttttatcgccagctgggcaaagagtatattgctgaaatgatatataaatatattgaattgatgtttactgtttatagtcatctgaaatatcatatttactctgattctactcacttgttttttaaaaataagtgtcctattattgtattatatattgatagaaactgttaaagctattttgaaaatatgagttcttagctttaatcatgaagtctgaagtttgctttcagtaattattttaaaagttgttttggttcattgctttataatatttattattgaatgccaaacctgttcttttttttactgtgtccaatattctttcaagcaaatgcaatggctggaatataattcagaattaactgaaacccagccagaagagggaccacctgtaaagcaagtcctttcaagtttcactgcacatcccaaaccatgttacaaaaagagcaactgctatattcacattatgatatttttctatcttaaatttgtcaaaataaagtatgagtctaactattaaa

SEQ ID NO: 29056 - DNA, 5781 bp, Homo sapiens
acgtgatgaggtccggaagcggctgccgggcagcaaaggaggatggcgaggggctgatactgaacccgggaagggtgggctgtgctgaagccagagccggagccggagctggggccagaacccgagcagtgagttcctccactggctgccggctggcggcgctcgccgccttgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaagctgggcttctttctcatctctctcccaaatgttgtatctcagtattcttcctattcgagtctccagggggtggctggacctacctggtcatttgaaacaggcccccaagctggagtttttaatctggactctctggcttgctgtgacccctaaggcaatgcttctcttccctggattccttagtgtgggtcacagtactgtgttcttagttgctttagctcttaaaacatacgaagtgttgcctaaactgaaaatatttatcttttatttaaaatcagatttttgtttttagactgtcttagatctggggctattacgaatcacttcttcttcagtaaactttgactcaacttctcctgctgaaaagaagctcgctccagatgtctgcatgggtcctcggcactcttggctgaggactcaaaggttttaatcaggatcgtctaaaaatgtacctcggtgaggaggcacagattttgcctcctgttgaccagcctggtttcataccgaaaagacattgaaggactgcagaaatgtatgggtgcaccgggccgagggaagggtggctgagtgagaggcgtataaaatggggctgtgtgcatgcaggcccatgtttcagcctcagcccacgccaggtgaaaggatcagcaatgctctgttgccatcgtgctgggacgacaccagctctattgccaccgatgagtagctgaggtcagtgtgcacagagtttgaaattaagttaatagactttacagcagctggtctgacactacgcgcagtgctcggttgtttacaatcagtggggaaaagggcagaaccagtgcccggccccacactgcctctgtggcctggactttgaaaggaacccactgaacactaattatgagccctgtctttcccccagaatgcctccctgggtttcacaaacagccttgaggttggccctcctcaaggtcagccttcagatttgggagcaaacttcagagaaggcagaggaagatacattgccttgctgtgggctgcctcttctttcctcttggtgtgcgaagtatttcagaaggccattgatgaattccccctctttagctgtgtatttgtgcacgtgtgtgtgtacgtgcgtgtgtgtgtgtgttcctgtgtaagtaacagaccagactccttttctcttctgtcccgtcaccaggctcttgcttcactgcagatacagttcactctgaaagctggttgaaggagagcagcaaaaatgtatcaggggttttgcttctgtgtttcgccaaagctcataagggctgtgacccacccatatggccccagttttttctgtctcttctgttccaaagccaggagagctgacttccaggtgaagggatgggaaaagtggactctcattgtagtgactcccaacctacctaataatttgttaacttaggaatatgctatcattgttgacttgttcttccttaggagaaggacgattttcacccaccctttctgttctatggtggactcttaacaggtgctatgtgaccaggaatctagccgggagtagcagaggccctgtcttctgaagtctcaggcttagaagttaccaaagtgggctcagaaactgtcatctcctggttccaagttcgggctctggcagcccagccgctatcttagctgtctttcccagcggtgctaagagtggtctcagtgagaaggtagatgccaactggagggccagacctgtgtcctgcccatgtcctccttggtggacgtttctgtttactcagagctgctagagaccatcctgcccatccgagttctgagattgggactgtgatgttgggacctgaggactggatggtagaatactggggtcccccagctcttagcaggatgcaggctattgcttccacacccctggccgtgagaacgtggtatgtaggagagttggctgtagctttaggatttctggaagccaatttggcatggcctatttgatctctggcttgtgctcctgctacactgacagactgattgcgtggctctttcagaagacccaggaagggcagctccagccagaggaccttcctggctatgcaggtgcacagctcttaggcatcaagcaaagggtcagccagtcagtagtagtgggaggaagcccttcctcctcttatgcaagcagctcgcagccagcccagaatctcttatgcagcccaaagggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttactttttcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgaga

SEQ ID NO: 29057 - DNA, 1389 bp, Homo sapiens
gcggctgccgggcagcaaaggaggatggcgaggggctgatactgaacccgggaagggtgggctgtgctgaagccagagccggagccggagctgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgagtgtaagttaaaagacaggatacccttctgtttgctgtggttgaaaactggtgacatttagaaaataaaagtaaattttttttgt

SEQ ID NO: 29058 - DNA, 552 bp, Homo sapiens
agcaaaggaggatggcgaggggctgatactgaacccgggaagggtgggctgtgctgaagccagagccggagccggagctggggccagaacccgagcagtgagttcctccactggctgccggctggcggcgctcgccgccttgggcaggacccacctcgccttcctcccggcgtggcagatgctccagaattccatcgacagagaggagaaaatacatctggggaatttgccgctgctctgagttccaaagtccaaaccaatgtaattgtttcagaataacggatgacacttttagcttgcaaacaaggggcgccaatgcgtgaattctggtaggagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctgg

SEQ ID NO: 29059 - DNA, 558 bp, Homo sapiens
atgtagagtggatggagcagatgtctgcttactagcatgtgggatgaatggagccgatgtccacttactggcattctcttgtttcccatagaagaagctctcactgagtctgtttacttccacccaggccttggaagaatcctgtacctctctcctttggccaggccttactgtgatgagcacataaagaattccatcgacagagaggagaaaatacatctggggaatttgccgctgctctgagttccaaagtccaaaccaatgtaattgtttcagaataacggatgacacttttagcttgcaaacaaggggcgccaatgcgtgaattctggtaggagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggt

SEQ ID NO: 29060 - DNA, 2005 bp, Homo sapiens
gagctcttcatccgcctgggcccaaccctggaactattcctttcaatggtgtcttttcttgccttgtttcagaaggatctactagttggccctatcttgtgccaagactgacagcaaggaagctgctggctgactgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaa

SEQ ID NO: 29061 - DNA, 1621 bp, Homo sapiens
agcaaaggaggatggcgaggggctgatactgaacccgggaagggtgggctgtgctgaagccagagccggagccggagctggggccagaacccgagcagtgagttcctccactggctgccggctggcggcgctcgccgccttgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgtgagtagaagatgataattgccttgcttgtttttccctaaagggcacccagtctgcaggctttcatgagaaaagacaatgtgtgttgtagtgaagctggctatgtttgtgacagagaacctggcccatggcctcactttcagagttgaggcacctccagatggggaagtgaattaattacatatgtactgtaaagaacatgggaatgaggacagtggtttatgtatagatagggtatgaaatgctgtggaggtggttatcattcagagt

SEQ ID NO: 29062 - DNA, 3421 bp, Homo sapiens
agcttggccagagccagcccgggcacacaccactgtgctggggtgtacatctacactagacaccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacagtgttccaggccttgattcacctggtgaaaggcaacatgggcacagggatcctgggactacccctcgctgtgaagaacgcgggcatcctgatgggcccactcagtctgctggtgatgggcttcattgcctgccactgtatgcacatcctggtcaagtgtgcccagcgcttctgtaagaggcttaacaagccctttatggactatggggacacggtgatgcatggactagaagccaaccccaacgcctggctccagaatcacgctcactggggaaggcatatcgtgagcttcttccttattatcacccaacttggcttctgctgtgtgtacattgtgtttttggctgataatttaaaacaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagagggccccaagtggcagcaactggccaaaggagatgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtgactttgcacctgctcctatgaaaagatgaagtctgtatctgtatcccttaaatttttttgcttgtttgtcggttttgttttgtgttttgtttttttgagatgaagtctcgctctgttgcccaggctggagtgcaatggcacaatctcggctcactgcaacctccacctcctgggttcaagcgattcttctgcctcagcctcccaagtagctaggattacaagtgcctgccactatgcctggctaatttttgtttttcgtagagatggggttttaccatgttggccaggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaattttaata

SEQ ID NO: 29063 - DNA, 2459 bp, Homo sapiens
atgaatgatactgccgttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagagggccccaagtggcagcaactggccaaaggagatgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtgactttgcacctgctcctatgaaaagatgaagtctgtatctgtatcccttaaatttttttgcttgtttgtcggttttgttttgtgttttgtttttttgagatgaagtctcgctctgttgcccaggctggagtgcaatggcacaatctcggctcactgcaacctccacctcctgggttcaagcgattcttctgcctcagcctcccaagtagctaggattacaagtgcctgccactatgcctggctaatttttgtttttcgtagagatggggttttaccatgttggccaggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaatttt

SEQ ID NO: 29064 - DNA, 2456 bp, Homo sapiens
gagcctggccccacgtccaggcaccaggacctccaatccaatggtgtcttcttcctcccagtcacactgttcactttgccctacagcagcaagggctaaactaggagaggccaaaagcccaggcaagtcctggttgggcaagcaattgcgagtgaaactgaggaccatcctgactgagatgggtctttcataagtcccccaagagccaggtgaggcatcatcaacatcagcctctcctgccaccaccgcttccctgattcatgcacttcaggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgatgatgcaaactttgatccacttgttgaaatgcaacattggcacagggctcctggggcttcccctggccataaagaatgccggcttgttggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaaggtacactgtcagcttcttattagtcatcacccagctgggcttctgcagtgtttattttatgtttatggcagacaatttacaacagatggtggaaaaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccccagtttgacttccatgtggatgttatataccttcatcaaatcccaacatctctatattaattagtggcgtctttatctttccaagagaaatgcagatgagaaaagttagcactgatgtctctcaggctacacctcttttggttttatattttttggatggccttttgtacctctgaaccaaaattagattcaactattcatattatcagcctcattttatggaaaagggatgccacttaccccaatagcccttgaaacagagaccaagcataaatacaaaagtaactgttttctctacactgcagtagctgcccttaaagcatcagatttagaaaagtgtatgttgggcgaagggagttttctatttagatattctaagtagaagagtcatagacagaacaaaaacagaactcagcagtaattttgtccaaccactggctccgccactgatttcctactggccctcaggcaagttcctccccatctctcagtctatgaagtgaacagttggactaactgattattaaggactctgtcaactctgatattctgaaagtgaataaaagaaattaacttatccaccaaccac

SEQ ID NO: 29065 - DNA, 1720 bp, Homo sapiens
ggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgatgatgcaaactttgatccacttgttgaaatgcaacattggcacagggctcctggggcttcccctggccataaagaatgccggcttgttggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaagatggaatttggctctgtcacccaggctggagtgcagtggcaagatctcagctcactgcaacccccaccttcagggttcaagcaattctcctgcccaagcctcccgagtagctgggatttacaggtacactgtcagcttcttattagtcatcacccagctgggcttctgcagtgtttattttatgtttatggcagacaatttacaacagatggtggaaaaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccc

SEQ ID NO: 29066 - DNA, 3042 bp, Homo sapiens
cgccggggcagggaggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagttatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagcttaattttagtgttgaatctatttgattatattttaatactttgaaaatgaatgtgtgatttttaatagtatatgtgacctgagcagaaaatcagggaactccaagaagcctacactgtggccatataaacctcagcaagagaaagaagctatgttcttttaaaacagaatagagaccgcttgctggtgaaactcctggctagtaagatgtgtgtctagctatactatttgtggcttgagcttttttaattattaccttcctttcctgagttttgtaggcaccacattcctgaatggcagaaaatagacacctcagaaaacggaggatttgtggactctttccagccctgtggcttttcttatcacagccttttatttattatgagcagaataaaagaatcagctaggtgtggtggtctgtgcttataatcccagctactctggaggataagttgggaggatcacttgagaggccaggagcttgagaccagcctgggcagcatagtgagacctcgactctataaaacataaaaatttaaaaaaaaat

SEQ ID NO: 29067 - DNA, 3664 bp, Homo sapiens
cggcggcgcaggtgaggcgcggggccggggccggaccgggaggcggggaccccccgcccccccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctagaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcgcattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactca

SEQ ID NO: 29068 - DNA, 3094 bp, Homo sapiens
tgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactca

SEQ ID NO: 29069 - DNA, 494 bp, Homo sapiens
ggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagctctttgcctggaaggtgcctgcctgcctgcctgccggcccttgaacttaaatcgtctgaagttgtagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtg

SEQ ID NO: 29070 - DNA, 568 bp, Homo sapiens
ggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtg

SEQ ID NO: 29071 - DNA, 3327 bp, Homo sapiens
gcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgt

SEQ ID NO: 29072 - DNA, 3436 bp, Homo sapiens
agaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagagtcaaggaaacttttgagctatttacagcttgtagcaattatgtaaagtatactcctctgaacaaaatttggagcatgtttgtttctctctacctgatttccccagaatctggaaactatctatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtg

SEQ ID NO: 29073 - DNA, 2332 bp, Homo sapiens
gcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgta

SEQ ID NO: 29074 - DNA, 3196 bp, Homo sapiens
accgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtg

SEQ ID NO: 29075 - DNA, 4888 bp, Homo sapiens
gatacacaaagagaaggcgcccgggcggccgcggtcccgcccactgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctg

SEQ ID NO: 29076 - DNA, 2728 bp, Homo sapiens
actggggtgtgcgcagcgcctggagcatgagccgggtggtggcgtgcacggaggatcgcgggaggctgccgcctcgggacaccccactcacacagagctgacgcaagttggacagaaggaggtgttggggtgaggtggtggtgttgattggcttgtctcgttcactcccactggtctttaaatcaatgtctagatctctaaagtttcatataaatcaaagctgttacacgggtctgccattccaaacaagtcaggaaagcctgcacaggactggataaataattaagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgaagatgaattacttcatgcctacagcaaagtgtatacattagacatcccccttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagaga

SEQ ID NO: 29077 - DNA, 1729 bp, Homo sapiens
gcagcgcctggagcatgagccgggtggtggcgtgcacggaggatcgcgggaggctgccgcctcgggacaccccactcacacagggcaaaaggatgtatacactccatcttcatttaaaacactggaggattggaaaggagaaaaggaacaggacagaaaaaaaaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtgatgatctacaagaaaataagtttctttttgcaaatttttatcatactaaagttgttcttttaatttagcatatctaaaataggatttagttcagtttagctcacacaggtgtttgctgacattcattggccatttaatacagtgttgagtggttctctgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgac

SEQ ID NO: 29078 - DNA, 3789 bp, Homo sapiens
actggggtgtgcgcagcgcctggagcatgagccgggtggtggcgtgcacggaggatcgcgggaggctgccgcctcgggacaccccactcacacagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgaagatgaattacttcatgcctacagcaaagtgtatacattagacatcccccttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggatttagttcagtttagctcacacaggtgtttgctgacattcattggccatttaatacagtgttgagtggttctctgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatg

SEQ ID NO: 29079 - DNA, 764 bp, Homo sapiens
aaaagaaagaagggtctctccatccatccctttctgatactttccctgaatcccagtctggaaagggtagtaaaagaggcggagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactgg

SEQ ID NO: 29080 - DNA, 933 bp, Homo sapiens
gcagcgcctggagcatgagccgggtggtggcgtgcacggaggatcgcgggaggctgccgcctcgggacaccccactcacacagggcaaaaggatgtatacactccatcttcatttaaaacactggaggattggaaaggagaaaaggaacaggacagaaaaaaaaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttag

SEQ ID NO: 29081 - DNA, 1988 bp, Homo sapiens
acaaatgccctccctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctacc

SEQ ID NO: 29082 - DNA, 2103 bp, Homo sapiens
ccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctg

SEQ ID NO: 29083 - DNA, 2662 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 29084 - DNA, 741 bp, Homo sapiens
ggccacgcggtgagggtggagggaaggagagggggtggcgcgggggaccggggaatgaaagacacagatggcaagagagacagcgatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaact

SEQ ID NO: 29085 - DNA, 708 bp, Homo sapiens
tttctgagatacctccttcccaaggagtaagcgcgggagggagctggggtttcttcagagacgctgtacctacaagacaggggctccaggctcgggtggggattgcagagacacccccaccccaggaaactcggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgg

SEQ ID NO: 29086 - DNA, 656 bp, Homo sapiens
ctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggg

SEQ ID NO: 29087 - DNA, 910 bp, Homo sapiens
agacagcgtgagtctggggtctgggaggagaggctatcccttctccacgtggtcggctcatctgcgctggggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctata

SEQ ID NO: 29088 - DNA, 871 bp, Homo sapiens
cgtctggggcaggggtctccgagtctgtccccaaccctcagctcactcaacaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccacc

SEQ ID NO: 29089 - DNA, 4058 bp, Homo sapiens
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggctgggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 29090 - DNA, 2427 bp, Homo sapiens
aggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 29091 - DNA, 2084 bp, Homo sapiens
gggagctatgggagggggcgggaattcccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagta

SEQ ID NO: 29092 - DNA, 2398 bp, Homo sapiens
gtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagac

SEQ ID NO: 29093 - DNA, 2723 bp, Homo sapiens
cagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtgatgagatatccatacagcctttctcatgcctcggtttcccccgtgcagtctccctgaataagtcacttgggaaagaaagtgtgagaagagaggaatgttcctggtacaggagtagatgagtcaccctgggtaggggaaggtcacaaagtggctggggccagggagctgcactctgctgaccaagcttccccattccttgccccatcttcctttgcatgatttttcccaaccactctggtctgtcttcctaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagaca

SEQ ID NO: 29094 - DNA, 1030 bp, Homo sapiens
ggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggct

SEQ ID NO: 29095 - DNA, 912 bp, Homo sapiens
ccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcggg

SEQ ID NO: 29096 - DNA, 1141 bp, Homo sapiens
agtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttc

SEQ ID NO: 29097 - DNA, 1409 bp, Homo sapiens
attcccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcct

SEQ ID NO: 29098 - DNA, 1268 bp, Homo sapiens
attcccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatca

SEQ ID NO: 29099 - DNA, 2289 bp, Homo sapiens
gccgcccggatcgccgccgccgccgccgcacggtggccttttgtgtttttcagtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcccggagtaagcagcgaggaagagcagcactggtcccaagcagaggccttgccctgctgggaccccgggagtgagagcagcccaaggatccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 29100 - DNA, 2291 bp, Homo sapiens
gggccgcccggatcgccgccgccgccgccgcacgtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagttgggtgttctcccgctgcagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcccggagtaagcagcgaggaagagcagcactggtcccaagcagaggccttgccctgctgggaccccgggagtgagagcagcccaaggatccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 29101 - DNA, 1379 bp, Homo sapiens
tgcagaagcagaagcaacacagaaagaagataccaacagcctcctgaaactcacgagagtggacactccagtgttgaccacctaagataccactcctgctccaaagattacagctcccttgtcattctgactcctgggcttaccctacaccccagagatggagcaactactaggaataaaacttggctgcctgtttgccctgttggctctcactctgggctgtggccttactcccatctgcttcaaatggttccagattgatgcagccagaggtcatcaccggctagtcctcagactcctgggctgtatttctgctggtgttttcctgggagcagggttcatgcatatgactgctgaagccctggaggaaattgaatcacagattcagaagttcatggtgcagaacagatcagcaagtgagagaaattcttctggtgatgctgattcagctcatatggagtatccctatggagagctcatcatctccctgggcttcttttttgtcttctttttggagtcgctggcattgcagtgctgtcctggggctgctggaggatcgacagtgcaggacgaagaatggggtggggctcatatcttcgaactccacagccatggacatttaccctcaccctcaaagggtcccctccgagcccttgtcctcttgctgtcactctcctttcactcagtgtttgaagggctagctgtggggctgcagccgacagtagcagctaccgtgcagctctgccttgctgtcctggctcataaggggcttgtggtgtttggtgtaggaatgcggctagtgcatttaggtaccagctcacgatgggcagtgttctccatactattattagctctcatgtcccccctgggcctagccgtagggctggctgtgactggaggggactctgaaggagggcggggcttagcccaggctgtgttagagggtgtggcagctggtaccttcctgtatgtcaccttcctagaaattcttccacgggagctagctagtcctgaggcccctctagctaagtggagctgtgtagccgctggttttgccttcatggcctttattgccttgtgggcctgagagattcctggcttttctgatggacctatttaggacaacctctctatccccagggagacctcccaaatggctttgaccctcagacatttctttactcagactaaatagcattcagtaggactggactggaccccaggtttcctttacatgagatcccatttctcaccctggactaagacaaagatatttaggttgagcagctattaattggagaattggtacagagacgctccagattttattcttatcccatttatgctactgtgtgtaataaaatgcccattttaccctc

SEQ ID NO: 29102 - DNA, 1423 bp, Homo sapiens
gggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttacc

SEQ ID NO: 29103 - DNA, 2983 bp, Homo sapiens
gggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaaggtaagggctccctgggcactagcagcagcccttggcaccttatggccaagggactctgatgcattttcaacactgatgccaagttcagtgaaggccttgatgctgtaagggtgacggaaagtaggaagtgaatttgctgtgtgattgtgaactggttactttctgtctctgtgctctaccggccaaacaaggggtttggaccagacctgggattcccaacaggtggacttgtcggttgtcacctgataatcagaccagactacccacctaggtagggcacactctgtcctgaagctggaaagcatggcctctcttcggttcctatatcagtcagctactgttgcgtaacaaattatagcaaactgagcaccttaggactacagacgtttatcatctcacagtttctgtgagtcaggggtctgggcactgcttcaggagctcacaaggcagcagtcacagtgtctcctgggctgtggtctcatctcaacgttcaaccggggatgggtcggcctctaagctcatgtggttgtaagccaggttcagttcctcattggttgtcagaccgaaggtgtctgtttgtcagtgtctgttggctggggcagccctcagagcctggccacgtggacctccccagcatgatcagttccttcatcagcaaatggagaagatggccatgactctgtgtaagacagagggcacagtcccatgtcatgcagaggtgacagggtatcccttcccctctgccccagtgtcctgctggttagaagcaagttcaagtccttcccatactcaagtggccaggacctcacagggtatggctgtcaagaggcaggggcttctggggccatcttggagtctgtccaccccaactcctgacagcatcatcctctgctgacctgttccttgagctcccccatatcagcagcccagagtgtgggtcccctgtcaggccacagtgtgaccagccctggccatgcttgctgggtgaccctgggtgagtggcttcctctctctgggccagtgccagatgtgacattgaatttgtgttggttacatacttggtggagatatgaggaccccctgttcttcctcccaacgaaagcatggaagccctaagcttatcccccaacccctggccctgcttttcctcgtgcctagtgtccagaaaggaggagaagggctgttgtctgggattaaatcatctgagcctgttagtgtggcagagtagagttccagggtggctccctgagcttccagcccctgctccgcacgccccatgctcttccctcccctcgagtgtgggtagggctgggactgccgtgcgtgtcactcctgccattatgtcagaatcccagcagaggggatgttgcagctgtgatgaccgccccagatcggttagcgctgagttcatcaaaagggagggggtgggcctggcctaatcaggtgagccactcaccctcctgctggccttggagaagcaaaaagccagggtgtgccaggagaagggcatgaagcgaggacccgagggcagcctctcggtgccaagagccatccccgccaacagccagccaggacacggggcctcagtccacagccaccaggaggtggactcttccgacctccagtgagcttggaagaggaccctgggtgtcagtgagatctcagccctgatgacaccctgcgagacctggagcgtagggcccagctagcccgcacctggatttccaccgttcagagccgagacaccgcattcctgctgttccgcgtggctgagtctgcattcgttcgttacgcggtgtgtgaagactgacatctgcactgcgaggatggagatcttggtcatctctgacatctcctgcatcgcagaggccactgccagccccccttttcccccatggtcatggtgtcacccccgtcaccctctgactgcaggcctgggcgactgcggggagcttgctcttccctccccctcatcacagtggccttctcatggcacccaaacctttcccgccgttctcctgtcctcgggctggtcaggcggatgaggtccctactcccgagcccccagcctcacccactgcagggccaggctctcagtcacccctggaaaatggtgcctggttcacagctcccgtgcatctgcctcatctctcctgatcaacgtctgtctcttgggagtagctagagttcctcatgagcttgtcctcaagcgaggcatgcatgaggcctccagccggtggtcagtgagggagttaagtggcttctccgtggaaacacagccttctgctgcagcagaggctcacccagcgtgaactgcccccagggaacactgggcgatgcctggggacattgtggttgtcacgatggggggtgctcctggcctggagtgggtggaggccagagacactgctcagcagcaccctgcagtgcccaggacggccccgtcccagagaacaatccagccccgaatgtcagcaccttccccctacccgagttgtgaaaataaaaaatgtttccag

SEQ ID NO: 29104 - DNA, 1219 bp, Homo sapiens
gtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggatctcgccgcccgagccccgagtgtcttgaggcttattagaggttggagtcactgcgatgggacagccgggctccgtccctc

SEQ ID NO: 29105 - DNA, 2297 bp, Homo sapiens
aaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagctgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 29106 - DNA, 2174 bp, Homo sapiens
agccccagtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagctgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 29107 - DNA, 2153 bp, Homo sapiens
atattggtaaaggcattagggcgaaggtggaacggaacttcctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaca

SEQ ID NO: 29108 - DNA, 2409 bp, Homo sapiens
tcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaca

SEQ ID NO: 29109 - DNA, 2409 bp, Homo sapiens; identical to SEQ ID NO: 29108

SEQ ID NO: 29110 - DNA, 2153 bp, Homo sapiens; identical to SEQ ID NO: 29107

SEQ ID NO: 29111 - DNA, 1015 bp, Homo sapiens
gggaggaagggcgggcgagcggcccaagacatgatccctggctgagagtagggataccgaagaggtcccagggattcccaaggattgatcggaggattagctgagcacgaggaagcccctgagagaaagactctggcctggattgggtcgaattaagcccgtcgctctgctcagtaccaaaatgacagcgccaatgtggcagccatctttgtacagacgggaagtctcggcgcgagttcccgccccctcgtctagttggaaaccgaggaggcggtctcctccggcctgttagcccgcctcgcccaccctcccctcaaatcacctccacactcgcgcatgcgtgtcagtgcaggatggattcgtcgctaccggagtgccgccatattggtaaaggcattagggcgaaggtggaacggaacttcctgttctcgcgggatctaaaggcgggactgccacgtccaagcaaaccgggaaaggagaggatcccggagccggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaag

SEQ ID NO: 29112 - DNA, 1015 bp, Homo sapiens; identical to SEQ ID NO: 29111

SEQ ID NO: 29113 - DNA, 2153 bp, Homo sapiens; identical to SEQ ID NO: 29107

SEQ ID NO: 29114 - DNA, 2409 bp, Homo sapiens; identical to SEQ ID NO: 29108

SEQ ID NO: 29115 - DNA, 2153 bp, Homo sapiens; identical to SEQ ID NO: 29107

SEQ ID NO: 29116 - DNA, 1015 bp, Homo sapiens; identical to SEQ ID NO: 29111

SEQ ID NO: 29117 - DNA, 1015 bp, Homo sapiens; identical to SEQ ID NO: 29111

SEQ ID NO: 29118 - DNA, 2409 bp, Homo sapiens; identical to SEQ ID NO: 29108

SEQ ID NO: 29119 - DNA, 2409 bp, Homo sapiens; identical to SEQ ID NO: 29108

SEQ ID NO: 29120 - DNA, 2153 bp, Homo sapiens; identical to SEQ ID NO: 29107

SEQ ID NO: 29121 - DNA, 2153 bp, Homo sapiens; identical to SEQ ID NO: 29107

SEQ ID NO: 29122 - DNA, 1015 bp, Homo sapiens; identical to SEQ ID NO: 29111

SEQ ID NO: 29123 - DNA, 1314 bp, Homo sapiens
ctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacagtgctgatctcagcagctccattttttgtcctcttccttatccccgtggagtcgaactctccccggcatcgctctctacttcagatcttgctcagttttgcttccggtgggctcctgggagatgcttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcct

SEQ ID NO: 29124 - DNA, 1842 bp, Homo sapiens
ctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctg

SEQ ID NO: 29125 - DNA, 1015 bp, Homo sapiens; identical to SEQ ID NO: 29111

SEQ ID NO: 29126 - DNA, 2409 bp, Homo sapiens; identical to SEQ ID NO: 29108

SEQ ID NO: 29127 - DNA, 1314 bp, Homo sapiens; identical to SEQ ID NO: 29123

SEQ ID NO: 29128 - DNA, 1842 bp, Homo sapiens; identical to SEQ ID NO: 29124

SEQ ID NO: 29129 - DNA, 1314 bp, Homo sapiens; identical to SEQ ID NO: 29123

SEQ ID NO: 29130 - DNA, 1314 bp, Homo sapiens; identical to SEQ ID NO: 29123

SEQ ID NO: 29131 - DNA, 1842 bp, Homo sapiens; identical to SEQ ID NO: 29124

SEQ ID NO: 29132 - DNA, 1842 bp, Homo sapiens; identical to SEQ ID NO: 29124

SEQ ID NO: 29133 - DNA, 1314 bp, Homo sapiens; identical to SEQ ID NO: 29123

SEQ ID NO: 29134 - DNA, 1842 bp, Homo sapiens; identical to SEQ ID NO: 29124

SEQ ID NO: 29135 - DNA, 1842 bp, Homo sapiens; identical to SEQ ID NO: 29124

SEQ ID NO: 29136 - DNA, 1314 bp, Homo sapiens; identical to SEQ ID NO: 29123

SEQ ID NO: 29137 - DNA, 2959 bp, Homo sapiens
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccccgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaa

SEQ ID NO: 29138 - DNA, 3947 bp, Homo sapiens
gctattggtcacactggcccagaggggcacgtgactgggaaggggcacaggctggtcccctccccctccttctcaggttcacccctgccggccatggacttcctcctgcggcctcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccc

SEQ ID NO: 29139 - DNA, 4387 bp, Homo sapiens
ccggccatggacttcctcctgcggcctcaggtgcgaggggtctgcgaccctctctccccatggcggcaagctccctgcgcctctccccgtcccctcgtcccacggggctgcttctggtgggagtggggctgggcgcttaggggagccaggagatggacaggagccttcctcacagaggggagaagccagccccctggcccgctcaccttctcttatccggtgttctgccagtcccagctgctccagtccccacctcgcccctaagacccgcccttcaccccagccctccccgcgctcttccttgttctggctgctggcaccgctatggagggggctgcatacccccgcccttggagatcccgatgcccttcaggtccagaagctcttgagcaaatatttggcggcgcctggagctgagaccgtgggtgggtggggggctggaccaaggctgcctggccaggcggctgccgcttagctgggctgagctcttacaagcgccgcattccctgccggctgtgccggccggccgctgctccgcgcccgcaggatgactcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca
